United States Patent 9,481,889 (GENE CONTROLLING SHELL PHENOTYPE IN PALM) - sequence listing, part 2

SEQ ID NO: 8218 - DNA, 3391739 bp, Elaeis guineensis (residues 1-1,695,870 of 3,391,739)
  3.4 MB genomic region of shatterproof1 (SHELL) shell thickness gene
  modified_base (1)...(3391739): n = g, a, c or t
ggatcgtttgcacggttgctcagggtcagtcggtatatcagtcggtatatcccaacagttgcccccccactcctgagcctgatatcacgtcagctcgcatttccacgcaggtgcggcgtcgggcgaaaggagtggatctttattacatcatgccctgatcctgctgatctcaccaacggacgatccggacaaatcggcgtcagacgacttgatgtctgatgatccgatgtcagacgatccggtgtcagacgatccgatgtcagacatcctctggggaacgcagaccaccgtctggcgctcctttaggagtgcagaccgtcgtcaggcatcccatcgggaatgcggaccaccgtcagcgaattaattctgaggcgcggttcttccgccacgtgtcgggaggtcgttgggccggagtcgttcgcgtggatgaaggtgacgtggcccgatctgggatgggtgcgtcgaatcgtcgggccggaggagggcccggatgctgccacatgtcaatcatccgagaggtcctcgtcggcgtgccctcatcccgaccgtcgaggggccctatatatatggtgtcacttgtatccaaaaccttatttttcgtggttctgctgtagagactctgcccgaggggtcccccttgtcccaggtagttgcttctgctcccattccttgagaagtcccttcgagacttttgtctcctttcgccttctccttgcttcttttggaattctctccccttcttcttcttctccatcttttccttcttcctggttctggcgtcatggtcaggacttctcctcggggagctcagtcggagaatccgactgatgatcttcggtcgaccccggaggtggaggcctcttcactttcgaggccgaatgtcgatcggcttcgggatcagtactgtatcccggagcagttccgactcttcacccctggggccgggggatgggtctacaacccgcccgcgggtcaggtggctctgtatgtcgaggaccttcgggccggtcttcatctcctgattctggagtttgtccggaactttctggattactacggactttgtccggtgcaactggcgccgaactcagttcggttaataatcagttttgctctgttgtgtcagcttttgccgaccaaccctcggatctctctcttccgggcgttcttcatcctccgaccccaccctaaagcccaaggatggtggctcttcaatcctcgaaagggtctctctttcatcactggtcttccatcgtccattcatgggtagaagaatcagttcttctttgtttcttcttcctctccttgggggtttccttcccactggggcgagcctctgactgggccgaacgagaacagccgagtggaggcagatgatcggaaggatttctaccgacttaaggacatgtcggtaccgaagcagagggagcttgttaccgaacaagccctctatgatgccggtctgagcctggtcccccgtctaggtactgtccggtccatcgattgtcttttcgcttctcgtttgtccccgaacacgtactgattctcttattgaaattgtaggtacgtcatcgaggatgagaccgacagatgccgagatcagacaatatgcagcgaggaagaggctggcgtctggggccgggccctcacgcctgtcgaaaaggtctcagatgttgcccccgaccgtcactgcatcgacggccgatcagtcggagccgatcatcgcgctctcgatgccggcagtgccatcaggggagcagccggtggagggaatggccgaaggagcgtcggcggcgtcgccgatggaggaggcccggggtgatgctcgggagcccgagcatccttcatcggctcccgttgctgcctcgaggggagctcaatcgagttcgtgcctcccctccttccccaatctacgggcctgggcggcgggtcgggggaaggccccgatggcccacgcgggcgactcaaggtcgggggaccgcgtcgggtcgtcgggtgcccggattccttagggagcgtcagtcctggccgaccatgacttggccaggagattatgccaggggaccctccttccagccgacctggaggtcctgaagactcgacgggtgaccgagatgctgtcttccttttacccgaccatgatcggggtaagttctaccttgccttctttcttcattgttgcctttactattctatctttctaacggtcggcttctgcttgcagttgatttacaccatgtccaagttagaggccggataccagaagttcgaagacgtccgggcggcctggaaggacaaggcaatgaccgtcgaagccgagaaggcggtgctgatcgaacagctgaagctgtcgaccgatcgggaggtgagactggaggatgagatctctcgccttaccgacgctttggctgcctcaagggccgaactcaagtcggtccgcgaggaagccaagcgcaagggtcgaaccgctcaccaattgcggtgcgagcgggatggcatcgtcgccgaacttgaggccgagcgtgagcagctctgggttagcctggagaacctcgccaaggtcgaggaggacttgtcaatcgctcaagccgacactgacatagcgaaggcggagacggaggcaaaatcggcgatggagtcgttaggtcgggcggtggaggacttctacggctccgacaaatatcgagaggagctcctggaaagcagtttcgcatcataccgggtggggtacgaagatgctcaggatgcagtcaaggctttgtacccgaagctcgacctcagcggcattgttcccccaggatcagaggagcaagccatagaagaggtggccgacccatcgtcgggggatcatacagcgatggaggaagccgtcctggagtaggtcgccgaaggggagacagccccgacctccaatccagcgccgacccgagcggacatgccggctgccctcgagcttctcccgattgaagaggtcgactccgaagagtaatcggagttgtttttgtcttgctttatatacttgtaatcgggcttcggcccaattttgtaaactcgatatatttatgagtgaaatcgagaatttttaaactttcttcccttggcatattaagacgcattctgagtcatgtgcttcgccgaagcgctttccaagcatgaagtcgtagacccgtcgtaccttattaggtcactcgctaatatcccaggtcgttagccgagatagtcggtagcgtgcaccacgaaaaaggcgaggcgagtttcgattacagaccagtcattttgacgttcgtaggatgtgaccgtcgaaggcctgagttgaacatccatcgtctggtcgtaaatcgggcgtgtttgtcgagtcgaaggtgaaagccgactgtgcgtcgctcagacgtgagtcgggcgtgttcgtcgagtcgaaggtcgaagccgactgtgcgtcgcccggacatgaatcgggcctgttcgtcgagtcgagggtcgaccaacctccggacatagcccgatgatccgatcattctgtagggtcgaatgtcgtccggtgcgttcagtcggaaggtgtccgacatgttcagtcagaaaaatgatggcaagtcgagtttccattacccagactttggtcgggtacatacgtcgcggtgcgtgataaacggtggtaagccgaatatccttcgaccggtcgtgacctggtcggttggccatgaatgcgacattggtcgcgttggtgtttggcctttcttggccggggccaagtcagcaacttagccaattattttgcccgagagtttgactgtagaaggagtgtgactcccgtcgttgtggatatatcgatcatcgtaagtgtccgatgtgtcgttggcgatcgggccgttgattctcaatggaacgttgggcccaagtcggggcgttggggctcgtactcctggcgagtgccgacccacagtcgaagagtcgagatttcggactccaaagttttgaaactgaatttgtattccggacaaggggatacagagttcactggtagtacaatcttagattgtcggcatttcaagtccgggggatggccgttccttctagggctctagtcggtaggcttccaaccgataggtgtcggctatcttgtagggtccttcccagttcggggataatttcccctggtctagaggcttcgaaacttctgcttttcttaagatcaggtccccggacctgaaaagcttcggcttgaccttggcattgtagtaccgggccaccttttgtcggtaggaagccatacggatctgtgcctcgcatcgaaattcgggcaagaggtctaagtcggctctctgacactcggagttgcccggctcactatactgctcgactctggtcgacggtagcccgatctccagcgggatcattgcttccgtcctgtaggctaagttgaagggagattccctggttgggacatggggcatcgttcggtatgcccataggacagagggcagttcctcaacccagaggcccctagcttcattcagcctgatcttcagtccgtgtagaatggttcgattggtcacttccacctcgtcgttagactttggatgcccgactgaggtcagcctgtgcgctatatgaaatctcgcacagaagtttctgaagttctggttgtcgaattgtcatccattgtcggtgataatgatgttcggcaatccaaacttgaagatgatggacttctggatgaagtcttccatcttccgcttggtgatttacgccagaggtttgacttccacccacttagtgaagtagtcgatcgcgacgactatgaactttcgttggccggacgccgaagggaaaggttcgagtatgtcgattctccactggacgaagggccacggggcgacgacgggagtcagctggctggcgggtcggtgttgtatgttggcatacctttggcatggttcgcacctccgaaccaactcagccgcgtccttcttcatggtgggccagtagtaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcgcaggactttgtaggtcaaggatttgccacccaagtgattaccgcagatcccttcaagcacttctctgagaggcatagtccacgtcggctggccccagacacctcagcaagggaagagagaacgaccttttgtagagtcaaccgtccaccaacacatattgggaagccgcccaccggagttgtttggcttccgcggggtcttcggggctagttccgtcggtcaggtactgaacgatcagatccatccagcacggctcgatcgccagttgtagcacctcctcagtcttgtcgatgcttggttgctcaagactttctacgagcgtccggcccaaagtgccgtagtcggacgtcgcgagcctggagagtgcatcggctcgagcattttttgccctacgaatgtgggagatctcgaaggacttgaagatcgctacgagatctcttactttctgatgatatttggccatggtcagatcccacgctttgaattcgcctttgacctgtccaacgatcagttgagagtcggagaagaccttgaggctgtcgaccccgagctcccgtgccaaccccaagcccgcgataagtgcctcatattcggcttgattattgaaggtcttaaagtcgaatcggagggcatgctcgacaaccactccctccgagttggtgagcaggaacccggccccgcttcctcgagcgttggaagctccgtcgatgtgcaacacccaggttgaatcggggtcatattcggaggtcccaacctcttcggggctcccctttttcgatgctcgatcggtcgtcgggcactccacgataaagtcggccagaacctgagctttcagagcaggtcgcggtcggtactgaatgtcgaactcgctcagtctcacagcccacttcgccaaccatcctgatgtgtcagggtggtgcaggatcgctctcaggggttggtcggtgagaaccacgatagcgtgtgcctggaagtatggatggagcctctgtgctgaaataatcagggcaaatatcattttctccgccatcgagtaccgagtttcggcttcgtggagcactttgttgatgtaatatattggttggtgaactcggttctcgttctctcggacgagcaccgagctaactgcctctggagaggtagccaagtaaagatacagcattttcccgacctccggcctcacaaccaggggcggagaagccaaatatttcttcagttcttcgaaggcccgtcggcactcgtccggccaagagaagtgctttgcttgtctcagggttttgaagaacgggaggcatctctcgaccgatcgagaaatgaaccgactgagcgcgatgatccttccgttgagttgctgcacctcctttttggtgtccggatgccgcatgtctacgattgctttgatcttctcatggttggcctcgatttctcgttgtgaaatgaggaacccaaggaacttctctaaggtcactccgaaggcgcacttagttgggttcagcttcatccgatgtcgtcgtagagtgcagaaggtttcttcgagatcttgcacgtgatctgaagtttgtgcactcttcaccagcatgtcatccacgtacacctccatgttgcgcccgatttggtctttgaagaccttattgacaagtcgctggtaggtagccccggtgttcttcagaccgaaaggcattactcgatagcagtaaaggcccttggcgatcacgaaagccgtatgctcctcgtcctccggtgccatccggatctgattgtatccgacgaaggcatccatgaagctgagcagtcggtagccggatatcgtgtccaccagttggtcgatctttggaagtgggaagctgtccttcggacggcccgattcaagtcggtgtaatcgatgcagatcctccacttcccgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagctgccgtcgcccgtggtcgggataattgcgatccgaccctgaccacccgttcagaattttctgttatcgggatggaaactagctgctcggtcggttcaccccgttcctgctcttctcgttgatccagcttgtcgatcggtaaggaatcctcccgcacgtcgctctgagtcaagatttggaagcatcgtcgagcgagctgttgatccccgtgcatctctccaactccatttttagtcgggaactggaccaacagatgatacgtcgagattatcgctctgaaggcatttagtccgggtcttccaagaatggcattgtaagccgaagacacttggacgaccgtgaaagttaagtgggtggtgctttgtcgtggttcggttccgaccgtcacagaaagagtagtttctccttccaccgtgacggcttccccgacgaaacccaccaggagcgtggagactctcttgagccgatcagtagatagtcgcattcgagagaaagtcgagtagaacaaaatgttgatcgaacttctattattgacgagaattctttttacatcataattagctattgttgccgagacaacaacagcgtcatcatgggagtttggattctccggatatcttcatccgtaaaggtaattacattatcctggcgcagcttctttgtcgactctcctgtagcagtcgtcccccgatccgctcatttggagatcatgttgatgaccccggccgttggttagttgttcgccgctttctcagtcggttggggtcgtcggtcggggatgggtcgagtcggcgcgctccgtcggaatttgtcgaggtaccctcatcgtatgagggcctcaatctcatctttgagctggatgtactactccgtgttatggccgtggccctgatggaatcgacagtactttcatcggtcgaggccttttgccttcaaaggtggaggccgccgcagatattcttctccttcgatctccatcaagatctgcgcacgaagagcagaaagaggagtataggagtcatacctgcgatgcatcggcctcgggctccaccatcggggaggtctcgggctcgaccgtcggggagttctcgggctcgaccgtcggggcgagacctgtttgtcggtcggaggaccgctaagctcggcaggggcccgacctttccttcgcttttccttcaggcccttggtctcggtcaggcaccgatcggaagctcctttgtctgcacgcatatatttgtatgcgcattccagcagttcggcgtatgttcgggggagggtcttgtccaaggagtatgtgaatcgggatgccctcagcccccgcttcatggtcgagatagtcatatcttcgttgaggtctcgaacctcaagcgtggctgcgttaaatcgcaccacgaagtgttggagcgtctcgttttctccctgtttgagggagaaaaggctatctgaggttcgtggcggctttcgactggtgctaaaatgggccacgaaagagtgcttgagctgtccgaaggagtagatgattccgaagcgaaggccggagtaccaagtcctggcggctttgcggagcgtggcgggaaagccaatgcagaggagggcgtcggtcgttccttggatcgtcatgagagccttgtagctctctagatggtcgacagggtcggtagagccatcgtaaggctccacatgtggcatcttgaaccgactggagatcggttcgtcgagtatgaatcgggagagggattgggcagtctggaagtcgacgtcgttcgaagacttctaaccatccacctggagctgggcgagccgacgatcgatttcttcgaacctacgctcgtagttgtccatccgtcggtgctgggagactctaggagtcaaatctcccgatgaatccaagagggaggcggacggtgctcgcggccgcttctccttccttgctcgctcgagctgggaaggaaaggggcgctgggaccggcagatgtcacgccgtggcggcctctctccctctcgatgggaatgcggggacagctgctcctgaggaggagacggagatcgacgcaggcgtcggcggctgcccctggacgacatcgggttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagacgaccccgaccagacgaccccgacggacgactccgacggacgaccccgacagatgactctgatgaacgactccgacggacgactccgacagacgaccccgacagatgaccccgacggatgactccgacggacgaccccgacggtcggcgtcgaataccgacatatagtcggtcagcccgtccaaataccgtacaactgctatgggcagttgtcctgtcaaggacatacggcatggccgccctggggcattgtcctaccgaggacatagattaatcccagtgacttgacagcccacgatgacttgacagtccacagcaacttaacagcccccgacgatttgacaactcctcaatcgtctgcaccattaatggcgggaccataccgcattctactataaaacaggataaggcaacggtattggggagttctaaggtccaagtctcgagctccctgaagttcctctaagctctagagctctctctctctcctgttgagcccctaatttttcactattgtctggtctcctctctgacttgaccatcagagggtccccgctgaaggcgtctccggtctgtgaggacttttctcgcaggtgcacgacaccgacgatcgggcgatggggggattggccgcaacaaatttggtgcgccaggaaggggtactcgacagagataggccagcgagctccacacagcttgaaaaacctctcgaaatgatgaaaaccagagctcaacgatcgagagctaccaggtcggcgaggcgttcttcctgttgggaagaggcccctccttcaccctccatggcggagcccagctctccgcatccggtggtaactatggaggtgcaaatcatgacgatcatgcggcaaatgaccgttctgacagatgcggtcaaaaatctccaacagcaaccgactcagttgccgcaaccgtcggtggtgcaccatatgccatccagaagcagccgtcgacgcctgcgtcaactcctgtctcctcttcaagagcagccgtcttagcactcccaccgagaaggagcgaggcagtcgcagcgtgacacccaccgatctcgatgtccttctccttcccagttggagcgggcgaggaaggagaagcggccgcggataccgtccgcctcactctcaagttcctcgagaggttcaacccctggggtctcaccgcaccgacggctggacgactacgaacgtaagtttaaagaaattgaccgtcggcttgtctagctctaggtggatggttagaagtcttcgaacgacgtcgacttccagaccgcccaacctctctcccgacttatcctcgataaaccatttcctagtcggttcaagatacctcatgtagagcgttacgatggctccaccgacctagttgaccatctggagagctacaaggctctcatgacaatctagggggcaaccaatttcctcctctgcatcggcttccccgtcatgctttgtaaagctgtcagggcctggtactccgacctccgctcggagagtatccactcctttggacagctcgagcattctttcgtggcccacttcagcaccagccggaagctgccgcaaatctcggatagtcttttctccctcaaacagggagaaaacgagacgctctgacactttgtggcccgattcaacacggccacacttgaggtccgggacctcaacgaagatatggctatcccgatcatgaagagaggactaagggggtcccgattcacctattccttggacaagaccctcccctggacgtatgtcgagctgctagagcgcgcgtataaatacatgcgcatggacgaaggagcttccgactggcgcctgaccgagggcacgggtcagaaggagaagcgaaagaaaaatcaggctcctgttgaccacagcgggccccaccgatagatgggtctcgtcccgataatggagtctgagaccgacgcatcgcaggtatgactcctacacccctctctccgctcctcgtgtgcagatcctgatagagatcgaagaagcggagtatctacgacggcctcggcctctgaaggcaaaggatctcgaccaacataacccgatcgccaatcgtcgaatccacggctcaattatcgatcgccgaaccgacggcctcggcctctgaaggcaaagggcctcaaccaaagtggctcgatcgtcgatcgtcgaatctatggctcgatcgtcgatcgccgaatctacgacccgatcatcgatcgcggaatccatggctcgatcgtcgaatctacgacggcctcggcttctgaaggcaaaaggccttgaccaatgcgatccgatcgccgaatctatggctcgatcatcaattgccaaatctacggcccgatcgtcgaaccgagggcctcagcctctgaaggcaaagggcctcgaccaatgcgacccgattgtcaaacctatggctcgatcatcgatcgccaaatctatgatccgatcgccgaactgacggcctcggcctctgaaggcaaagggcctcgaccaacgtggcccgatcgtcgatcgccgaaccaacggctcgatcgccgaccaacatgacccgatcatcaatcatcgaatacacagcttgatcgccgatcatcgaatcaatacggctcgatcgtcgatcgtcgaatccatggctcaatcgtcgattgccgaaccgacggcctccgcctctgagggtaaaaggtctcgaccaacgcggctggctaacttgctaacttagcttcgactaagaagggcaaaatgttaggatgaccgcagtcgtgctcgcgacataccgacttggtcacgaccagtcgaatgatattcggcttgccaccgtttatcatgctccatgacgtacccgcccgaccaaggtccgggcaacgggtatttgacttgcgacacaccgactatcaagttctacgacagagatcgaatgggtggaatatctacgacggcctccatctctgaaggcaaaaggcctcaaccaatgccgctggctaacttgccgacttagcttcgactaagagcggcaaaatgccaagacgacagtagttcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgttactcgactatcggatacgtcggatgctactcgactatcagactcaacgggatgatcgtgtcatgctacgttcggaggttggccgacctccgacccaacgtgcacgctcgacctatagtcgggacgaccgacatcagatgttagttgatgcgatcgccagagtcggggcaagacatgacggaaagccactcctttcgtccgaagccgtcgcccacgtgttcgcgcgagccaaacgacatcggactcaggagtggggggacaactgttgggatataccaactgacccttatacgccgacttaccctcggaccggtccgaccgatgcccgacggacgacttcgacggatgaccctgacggatgactccgaccgacgatcgatggatgactccgacggatgaccctgacggacgactccgatcgatgactgacggacgactccatcggacgaccccaacggacgactccgacagatgaccccgactgacgacctcgatggatgaccgacggacgactccgatcgacgaccgatggatgactccgacggacgaccccgacagacgactccgacggacgaccccgacagacgactccgaccgacgaccgacggacaactccaacggacaaccccgatggatgactccgacggacgaccggtggacgactccgatcgacgaccgacggacgactccaacagatgatcccgacggacgactctgacgaacgactctgatcgacgaccgacggacgaccctaatagatgactccgatcgatgaccgacggacgactccaacggacgaccccaacagacgacttcgacggacgatcccgatggacgacttcgatcgatgaccgacggatgaccccgacggacgactccaaccgacgaacgacggatgactccgacggacgaccccgacagacgaccccgacggacgactccgacggacaatcccgacggtcggcaccgaataccgacatatagtcggtcagtccgcccaaacaccgtacaactgctatgggcagttgtcctgtcaaggacatgcggcatggccgctctggggcattgtcctgccaaagatatagattaatcccagcgacttgacagcccacggtaatttgacagcccacggcgacttaacagcccccgacgatttgacaactctccagtcgtctgcaccattaatggcgggaccataccgcgttctattataaaatgggtgtcacgctcctgacccgagattgtgaatcgagggtcatggcaaccgccgcatactcatagaaaactctttccataagcatgcaaggcatcttatcatactatcctaaaacaacagtgaaataattagtcaataatttaaatctaaaatataatgacctaaattttnnnnnnnnnnnnnnnnnnnnttaaaaaggctcaaaatatgtagctgttactagcactccataaacataatttcttcctaatcgctagaggttcttctcatttgatggcctatccaatggatcatggatggcaccatggaaacaagtactgcgatttaaaacgtgcactatggcatggtccagcgtggtacattgtgttttgttaaaaaaaaaattgcatgtcatcagaaagcgctttaaaaaatttcagaacctgtgctctgagattcctgcttaaaaaggaaaaaatattaaatccttttactattaaatgccaaccatatgtctaggttccaagattcccacaaaaacgtaaaaataaagtccgctgtcttcctgccttcttttaggaattgcatgatggatccatcgactgataagatttttctgcacacatcgccaaggttttcttagatctgcttcccatcaaatgcaacttggaacgtggcagcaagaggatggttgcacttcaatcattaaaagtaaagccctcattctttttctgtgaatacgatttttttttgataaaaaaaagaaaaaaagcagtggagaactaccactcaacttttattagaacaaagggttgcaagaatgtataatgagaaagagaaaactaaagaacagtaacaaagagattcatcaaagagatagggtatcttactcttggttacagagttagccacaacccaacattggtccagttaaagcacctattataaaaaaactcgtaccatagaaagccacttcaatgatcactttcagcacatgccttgagcctgtagaggttatctgcatatcgcctagttatcaattggaagaagaacacatcagagaagagagtttagtgcaaaaaagagcatgaatatcggcctctttcctcttgcaaatgagctcccaactaacaaatgtatccagaatttttgcaaaacagaatagacagagctatttttctgaagaaatatccgnnnnnnnnnnnnnnnnnnnnnnnnnnnnnnnnnnnnnagtgttcctctctttccagatttctcaacacaaggcagccatcaattgatccatcacctttcttcctaaggctggaaatttggctcttctacatttagtgcagaggtaatgcagattggacagccatccatatatctttagctgaatttttagaacagtccaaatactacgtgcaaatggatatttgatccaaagatgagagatggattcaagtaatgccccgcaaagaatacaaccagagctaattgaccaaccttttctttggagaacctcaccagtgtgtagtttcttgcgaagagccaaccacaaaaacaccatcaccttctctgaaatagccactttatttatttatttttttacttttttctttttcagttcctcgctgttgtccatatgactgcaatggcccctgttgcagtttactagattaaagtcatcgatgctgttatgattattatgtaaccatgtctttataaataaataaaattccctacttgccaaggtattggcaatgcatgtgcatgagtaagttatttgtgataatggcgtgcgtttggaatgttgtttagatatgtccagctaagaactggggttccattgatgttttctggttctctgattctgaaacttgtttgctatggagtgctgagagacaccaatactggtattgagattgcatttcagaggcagggaaaaagatatgggtggtgttattttcagctagaaatctttgttctcttcagaattacgtcggaattgaattcatggaggagtataaggtgccctatgaagggggaaacagcgccaagggtattccctgaacgccatcagtctatgactgctggttcttgccatggggcatcgaggtattggactctagttactctagcatggagtcaaggcacagggattatcattttccacagcagattgttggaataaaaagctgtctgaattcccaggtggaatgctatgtgaatttgatatgtgatcaatgggaagtcatggtgggtacattcatgaaactcttttgtgaatttgttagaataaacttgatgtaaatttcaattttttgagagttaccttggaaaatctgtgaaaattggaactctcaagatctgtgaggttggatcatgtgtttctcactgctaaaagagacttcagatcgtatgtgcgatcactgatggaaagtacgtaaataaatccatcattttaagtgctttgattgttagaataagatgaaaagaccaaagagagtatttgataattttcacatgtctctctcagaagtctttttacattaattccctctattatttaaatttagatgatcatgatctagcaaacccatcatggatggcccaatcagattcaaaatccaaaataccatatattcacatcatcattcacattatttgatgaagcaattaataaaaaataactgtaatcataattaacaaaagcactataattaacatctgatacgataaaatcatctaataaatatccagtgctataataagttgtccctaaaaatacattaagacaagtaccatgaaaattcaaactatatcctaataattatacaaattaagtttcgtcgaatatttgatgcatatatgacatcatatagaagcagagtatgaccaccatttaatagtaacttataggtgccaatattttttgctccaactctggaattatctcttatatatatccatcttgtgtcacgactaattcaacgatactccacaaaagctcttctatctctagctatatgatctgtcgctcttgagtcgacaatctacacaacggaattcaataagcaaaaaacaactagaaacataagaataatataatataatggagcaagagcatacctttttttggctagtgcactcacgagtgaagtaatccagtttgctatatttgtagcagcatatctcaatcttgtccttctttttactaccatgcttgtctttcttgtgtcagttattcttattaaatttggatacttgtcctttctctttacccattttgagaaatttccatcttttacacttgaagccaggaatcttgtgtgagctagattcaactacataggctaacctgaaagatttagctgccttaaggcactcatcttctacctccaaatgacatactatatcatcaaaagtttttacattatcattgtgtatcatagtatgttggaacaatatttaaaaccagatgtgatttaagaaaagtaacgagagttttgattgcaaaggaatattgtaaaaaacttatagaaatttaaaaataaaaaataattaaattcagaatcgtgttggatattgttctaatatatattaccatctctcgtgcaagaatatttgaaaaaatgaacctaagatacgactaggatcttccgcctgcgagtacaatcatggaggaggttgactgatgaagaaaaaaaaattataattgaagagaaaaaatcattaaagaaagaagattagaatgctcttagatatcctataagtttagagtaagattagaaaaaatcaccaacccggtcttcaatcgatctattttaagcatgtttatgtctgacataaatagattcatgctgtaaatggatagactcaaacgtcctcactatttattaaataggttaggttcaagttccattgtctaacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgacaggacagcgccccgggctcctggcaggacaacgccccctggcggttgcacggcctgtccttgacaggactgcagcccatgccgttcgttcggcatttttgagaggggccgaccgactatatatcgggatgtggctatcgggcggtgactcaagagcacagtcggcgtctagaagggcctatagaagtcgggcgtcggttgtccaacccgacaaggagtcggcgatgtcccacccgacagggggtcggcgatacagggtcggcttcgggtgatcggaggcaatgttgggcagtttggccgacacgctcgggcagggcatcatcggtagtcactattggtgtcgcccattgccagacgggcaaagtcggtcggtccatctcaaggatgggtcagcatcgggacccatcagtgaatcggcgtcagggtcagtcggtatatcccagcagttgcccccccactcctgagcctgatgtcacgtcagcccatgtttctacgtaggtggggcatcgggcgaaaggagtggatctttattgcatcatgccctaatcctgttgatctcaccaatggatgatccggataaatcggcgtcagacgactcgatgtccgatgatccggtgtcagatgatccagtgtcagacgatccgatgtcagacatcctctggaaatgcagaccaccgtctgaagctcctttaggagcacggaccgccgtcaggcatcccatcgggaacgcggaccgccgtcagcaaattaattctgaggcgcggttcttccgccatgtgtcgggaggtcgttgggctggagtcgttcgtgcggatgaaggcgacgtggctcgatctgggacgggtgcgtcgaatcatcgggtcggaggagggcccggatgctgccatgtgtcaatcatccgagaggtcctcgtcggtgcgccctcatcccgaccgtcgaggggccctatatatatggggtcgctcgtatccaaaaccttatttttcgtggttctgctgcagagactctgcccgaggggtcccccttgtcccaggtagttgcttctgctcccattccttgagaagtcccttcgagacttttgtctcctttcgccttctccttgcttcttttggaattcactccccttcttcttctccgtcttttccttcttcctagttctggcatcatggccaggacttctcctcggggagctccgtcggggaatctgactgatgatctttgatcgaccccggaggtggaggcctcttcattttcgagaccgaatgtcgatcggcttcgaaatcagtactatatcccggagcagttccgactcttcgcccctggggccgggggatgggtcaacaacccgcccgcgggctaggtggctttgtatgtcgaggaccttcgggccgatcttcgtctcttgatttcggagtttgtccggaaccttctggattactacggactttgtccggcacaactggcactgaactcagttcggttaataatcagttttgctttgttgtgtcagcttttgccgaccaaccctcggatctctctcttcagggtgttcttcatcctccgaccccatcctaaagcccgagggtggtggctcttcaatctccggaagggtctctcttttatcacggatcttccatcatccattcatgggtggaagaatcagttcttctttgttttttcttcctctccttggaggttcccttcccactggggcgagcctctgactgggccgaacgagaacagccgagtggaggcggatgaccgggaggatttttaccgacttaaggacatgtcggtaccgaagcagagggagcttgttaccgaacaagccctctatgatgccggtctgagcctggtcccccgtctaggtactgcccggtctatcgattgtcttttcacttctcgtttgtccccgaacacgtactgattctcttattgaaattgtaggtatgtcgccgaggatgagaccgacagacgtcgagatcagacaatatgcagcgaggaagaggctggcatttggggccgggccctgacacccgtcgaaaaggtctcagatgtagcccccgaccgccactgcatcggcggtcgatcagtcggagccgatcatcgcgctctcgatgtcggcagtgccatcaggggagcagctggtggagggaatggccgaaggagcgtcggcggcggcgtcgatggaggaggcccaaggtgatgctcgggagcccgagcatccttcgttggctcccgctgctgcctcggggggagctcaatcgagtttgagcctcccctccttccccgatctatgggcctgagcggtcggtcgggggaaggccccgatggtccacgcgggcgactcaaggtcgggggaccgcgtctggtcgtcgggcgcccggatccccgagggagcgtcagccctggccgaccatgacttggccaggagattatgccaggggaccctccttccagccgacctggaggtcctgaagactcgacgggtgaccgagatgctgtcttccttttacccgaccatgatcggggtaagttctaccttgtcttctttcttcattgttgcctttactattctatctttctaacggtcggcttctacttgcagttgatttacaccatgtccgagttagaagccagatatcgaaagttcggagacatccgggtggcctggaaggacaaggcaatgaccgtcgaagccgagaaggcagtgctggtcgaacagctgaagctgtcgaccgatcgggaggcgagactggaggatgagatctctcgccttaccgacgctttggctgcctcgagggctgaactcaagtcggtccgcgaggaagctaagcgcaagggtcgaaccgctcaccgattgcggtgcgagcgggatggcgtcgtcgccgaactcgaggctgagtgcgagcagctccgggttagcctggagaacctcgccaaggccgaggaggacttgtcaatcgctcaagccaacgctgacatagcgaaggtggaggcggaggcgaaatcgacgacggagtcgttaggtcgggcggtggaggacttctgcggcttcgacaaatatcgagaggagctcctggaaagcgattttgcatcgtaccgggtggggtacgaagacgctcaggatgcagtcaaggctttgtacccagagctcgacctcagcggcattattcccccaggatcggtggagcaagccacagaagaggtggccgacccatcagtcgggggatcatacagcgatggaggaagtcgtcccggagcaggttgccgaaggggagacggccccgacctccgatccagcaccgacccaagcggacatgccggctgcccccgagcttctcccggttgaagaggtcgactccgaagagtaatcggagttgtttttgtcttgctttatatacttgtaatcgggcttcggcccaattttgtaaactcgatatatttataagtgaaatcgagaatttttaaactttcttccctttgcatattaagatgcattctgagtcatgtgcttcaccgaagcgcttcccaagcatgaagtcgtagacccatcgtaccttattaggtcgctcgctaatatcccaggtcgttagccgagatagtcggtagcatgcaccatggaaaaggcgaggcgagtttcgattacagaccgatcgttccgatgttcgtaggatgcaaccatcgaaggcctgagtcaaacttccatcgtctggtcgtaaatcgggcgtgttcgtcgagtcgaaggtcaaagccgtctgtgcatcgcccggacgtgagtcgggcatgttcgtcgagtcgaaagtcgaagccgactgtgcgtcgcccggacatgaatcgggcgtgttcgtcgagtcgagggtcgaccgacctccgaacatagcccgatgatccaatcattccgtagggtcgaatgtcgtccagtgcgttcagtcggatggcgtccgacgcgttcagtcgggaaaatgatggcaagtcgagttcccattacccagactttgatcgggtacatacgtcatggtgcgtgataaacggtggcaagccgaatatccttcgaccgatcgtgacctagtcggtaggccacgaatgcgacattggtcgcattggcatttggcttttcttggccggggccaagtcggcaagttagccgattgttttgctcgagagtttgactgtagaaggagtgtgactcccgtcgttgtggatatatcggtcatcgtaagtgtctgatgtgtcgttggcgatcaggtcgttgattcccaatggaacgttgggcccaagtcggggcgtcggggctcgtactcctgacgagcgccgacccacagtcgaagagtcaagatttcagactccaaagttttgaaactgaatttatattctggacgaggggatacagagttcactggtagtacaacctcagattgtcggcattccatgtccgagggatggccgttccttctagggtctctagtcgataggcttccggccggtaggtgtcggctatcttgtagggtccttcccagtttggggacaacttcccctggtctagaggcttcgaaacttctgcttttcttaagatcaggtctccggacctgaaaagcttcggtttgaccttggcattgtagtaccgggccaccttttatcggtaggaggccatacggatctgtgcctcgcatcagagttcgggcaagaggtctaagtcggctctccgacactcggagttgtccggctcactatactgctcgactctggtcgacggtagcccgatctccagcgggatcattgcttccgtcccataggccaagttgaaggaagattccttggttgggacacggggcatcgttcggtatgcccataggacagagggcagttgctcaacccagaggcccctggattcattcagcctggtcttcagtccgtgtagaatggttcggttggtcacttccacctcaccgttcgactgtggatgcccgactgagatcagcctgtgcgctatatgaaatctcgcacagaagtctctgaagtcctggttgtcgaattgtcgtccattgtcggtgataatgatgttcggcaatccgaacctgaagatgatggacttctggatgaagtcttccatcttttgctcggtgatttgcgccagaggttcggcttccacccacttagtgaagtagtcgatcgcgacgactatgaactttcgttggccagacgtcggagggaaaggtacgagtatgtcgattctccactggacgaagggccatggggcgacgatgggagtcagctggctggcgggtcagtgttgtatgttggcatacctttggcatggttcgcacctccgaaccaactcagccgcatccttcttcatggtgggccagtagtaatcctgtcgcaggactttgtaggccaaggatttgcctcccaagtaattaccgtagatcccttcatgcacttctctgagtgcatagtccgcatcggctggccccagaaacctcagcaagagaagagagaacgaccttttgtagagtcaaccgtccaccatcacatattgggaagctgcccaccggagtcgtttggcttccgttgggtcttcggggctagttccgttggtcaggtactgaacgatcggatccatccagcacggctcgatcgccagttgtagcacctcctcagtcttgtcgatgcttggttgctcgagactttctacgagcgtccggcccaaagtgccgtagtcggacgtcgcgagcctggagagtgcgtcggcccgagcatttttcgccctgcgaatgtgggagatctcgaagtacttgaagatcgctatgagatctcttactttctggtgatatttggccatggtcagatcccacgcttcgaattcgtctttgacctgcccaacgatcagttgagagtcggagaagaccttgaggctgtcgaccccgagctctcgtgccaaccctaagcccacgatgagtgcctcatattcggcttgattattgaaggccttaaagtcgaatcagagggcgtgctcggcaaccactccctccgagttggtgagcaggaacccggccccgcttcctcgagcattggaagctccgtcgatgtgcaacacccaggttgaatcggggtcatattcgaaggtcccaacctcttcgaggctccccttttccgacgctcggttggtcgtcgggcactccgtgacaaagtcggctagaacctgagctttcaaagcaggtcacggtcggtactgaatgtcgaactcgctcagtctcacagcccactttgctaaccgtcctgatgtgtcagggcggtgcaggatcactctcaggggttggtcggtgagaaccacgatagcgtgtgcctagaagtatggatggagccgctgtgctgaaataaccagggcaaatatcattttctctgccttcgagtatcgagtttcagcttcgtggagcactttgctgatgtaatatattggttggtgaactcggttctcgttctctcagacgagcaccgagctaactgcctctggagaggtgccaagtaaagatacagcattttcctgacctccggcctcacaagcaggggcggagaagccaaatatttcttcagttcctcgaaggtccatcggcactcgttcggccaagagaagtgctttgcttgtctcagggttttgaagaacgggaggcatctctcgatcgatcgagaaatgaaccgattgagtgcgatgatccttccgttgagttgctgcatctcctttttggtgtccggatgccgcatgtctacgattgctttgatcttctcggggttggcttcgatttctcgttgcgaaacgaggaacccgaggaacttctccgaggtcactccgaaggcgcacttagttgggttctgcttcatccgatgtcatcgtagagtgcggaaggtttcttcgagatcttgtacgtgatctgaagtttgcgcactcttcaccagcatgtcgtccacgtacacctccatgttgcgcccgctttgatctttgaagaccttattgacaagtcgctggtaggtagcctcgacgttcttcagaccgaagggcattactcgatagcagtaaaggcccttggcggtcacgaaagccgtatgcttttcatcctccgatgccatccagatctgattgtattcggcgaaggcgtccatgaagctgagcagtcggtagccggacatcgcatccaccagctggtcgatcttcgaaagtgggaagctgtcctttgggcaggcccgatttaagtcggtgtagtcgatgcagatcctccacttcccattggctttcttcaccatgacgacattggcgagccaatcgggatacgtggtctctctgatgaagcccacctcgagtagcttgtccacttcttcgtcgatggccttctgcctttcgggagcaaaagatcgcttcttctgcctcaccggccacatgtcagggctgatattgagtcggtgggtcattatttttggaggaatgtcggacatatccactgccgaccaagcgtatacgtcggcattggctttcaacagctctatgagctgccgtcgccctgggtcggataattgcgatccgaccctgaccatccatttgggattttctgttatagggatggaaactagctgctcggccggttcactccgttcctgctcttctcgttgatccagcttgtcgatccgcaaggaatccttccgcacgtcactctgagtcgagatttggaagcatcgtcgagcgagctgttgatccccgcgcatctctccaactctatttttagtcgggaaccggaccaacaaatgatacgtcgagattatcgctctgaaggcatttagtccaggtcttccaagaatggcattgtaagccgaagacacttggacgaccgtgaaagttaagtgggcggtgctttgtcgtggttcggttccgaccgtcatggaaagagtagtttctccttccaccgtgacggctttcccgacgaaacccaccaggggcgtggagactctcttgagccgatcagtagatagtcgcattcgggagacagtcgagtagaacaaaatattggtcgaacttccattatcgatgagaattctttttacatcataattagctattgttgtcgagacaacaacagcgtcatcatgaggagtttggattctctgagtatcttcatccgtaaaggtaattacattatcctggcgcagcttcttcgtcgactcccctatagcagtcatccctcgatccgctcgtttggagatcatgttgatgaccccggccgttggttggttgttcgccgcttcctcagtcggttggggtcatcggtcggggatgggtcgagtcagcgggctccgtcagaatttatcgaggtaccctcatcgtatgagggcctcaatctcatctttgagctggatgcactgctccgtgttgtggttgtggccccgatagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacaaaacaccatcaccttctctaaaatagccactttttagataattttgtagtaagggcaaacaagtcctccattgttaagaaatttatagtaggattcaacagtgtaaatactagattttgagagtttccatgaaggtgcatccgcaactcttgatggtttgatgatggccaaactagcttgaaacaactccaaccgtctactttggagtaaggaaagagatccattgagcttgatacgcgaagccaaagacctccaagactattgtgagacaaccgagtaattgggcttacaagtaatactacagagattctcgaacaaagaggagaatagtaccgaagcacaccacttatcttcccaaaaatgaatattatatccattaccaaggttaaaggaaaggcaatcccagaaagcacaaagttgcttgcaaatgtctctccaagtatgagacatctttttcatgcttcgcttaactcccatccccatcttcctcttttgataatatgcatatttgatttgcaaccaccagggagatttttaacccagagtaaattttcatgcccattttgctaaaagagcaaggttgaattgctctaagtttttgatatcccaaccatccttctcctttgaacgacaaatgttgtcccaattaacaagaaaatggaagccactaacactatcatgccccttctataaaaaagcatgccgccacctgtcaatgcgatgaagcaaccattttgacagtttaaatataaacatgtagtaagaggagagagcaaacataacggagttgataagagccagccttccacttcaagatagaaacttttctttccatgaggctaatctagggttgatcttttcatgaaaaggaagccaacactgtctagaaattctcttgtcacataaagagaggcccaaatagataatcgataattgtcttttcttgcagttcatcatagttacaaaagtaaaggcttcaacatcatccatacacatacaaacaatcaagcttttataaaaattaatttgtaaacctaaagcactctcaaaacccaagaagatagctttcacaatcatcaagctttgtttatctccagtacataacaataaagtgtcatcgacaaaagaaagacttctgatgccctgaaaagcaacattctcactgatttctttaaccaagccaagggagccagcatgcttgagtaatctggatagtacatcagcagccaaaataaagagggtaggggataatgggtcactttgtcacaaatcctgacgatatttgattcaattatttggtctaccattaactaaaagagccacagaggaagtgctcaagagatcctgaatccaacaaatccatttggaaggaaaacccctcatctctgggagatcaagtaaaaaatctcaattaagcttatcaaaaatctttttaaaatcaaatttgcactcttttaacactgcctcttttgcaataggcaatttttttgcgaatatgttaaccatgattgtgggctttctaagctctactatgctcccaacaaaggcacccaaaggcctgcaaatgggttgggtcggatcgagtcccgagtgatcctgatctgatccaatttcttgatcgggtcttgatattggatccatcccatcctgataaaaaatcaggttgggtcggatcggatccatagccgaatttattgacccattagacattcagatcagatcggatccatatataacccggtctcaatccatgaaatgggggatcggatcggatcggatcacgagtttaatttatttgaaacctaccatcagtgaatactaatgttggatgacaactaagaaagatctcttttttttttttttctccaatcctccaactgtaacttctaataattaattgtattggatagtaaaggaaaacaagcggtttttgagaagagtcaagatttcagaaatccacacaaaagaagaaatttaaaaaataaataaattttatatagtgatataattgttccaatctaaaacatcatataagaggaatacttgtacatgattaaaaatgagattatatatactgtggatgatgcaatatctgcgcacattagagcatgctttgaaattttttaaagtcaacaaaatgaattgaaattcaagaagttttcttacttttatacctcatagcacagtaaatataaactagaaggtttaaaaaattgagctcagcaagaagccagaagaagtagtcgaaatatcttttatttaaattatcaggaatccatccaatattttttcttcgggttgttatagatgttacaatagtcagaataaaagaactgaaggatttgaaaaatttttagttttgaagattttttgtttgagaattggatggaaaagatcaaaggatttgaaaaattttgattcaagtccaaatctctatttgggtgagtcactctaactaggttcgagtcctatgtttagatccggatcgagtcggatcacgtatcttaagatacaaattaatccaaaaatcttcacgaatcagatcgggtcgggtcggatctcaatttaaaaaattcagattcgattcagaaaagaaaatagatctaatttttgaatccaatctaattttatgattcttttaaatgagtttagatcaaatctaaatgaattgaattggatcaaattatggatcaatccgaaccatttgcagccttgggcgcccatcaaccgagtggtcctttggtttgctcaccggaacaagaaaagcacaaaacaaactacaatttctctggctcatacacacggccggccctggggcgggtcaaagcaggcgaccgctccaggctcctattttttttttttgtctggataaaccaaacgccttcttcctctcccgagtcccagcaccccaacgacttttttggataaaccaaacgtcttctccctttcataacctgtagctcctctcccccgcctcctcctccgtctccaatcttttcatcctattctgctgtccatcgatgattctttcttattttggacgtcaaaaatcagatcaaaatccgtcaaaaaatcaagtaaatctcttcaatcctcctctttcaatttgctatgaataattaatatttaaaatatattaattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcctccacctccgctcggcccactcccccctccgcctcctccatcgaggcattagtgggactgggagttgaaagccgtgtaaatttttttttaatgactgttgcagtgctgtatcacagtgaagcaatgggctgctgcttatgacccgtgagtccatgaccatgagtcctactctgtgggtcatgaaaaaaaaattttttaacagaagtgggagaaattattgatgattcaatactgttattttatcttctacttataaattataaattatagctcaatttaattttttttatagattatcaaaatggcctctattaaggggagcatgccatccatggatgatacaagtaatacttcatcttctggagttaaagataaaagtaatcctgcatgaaatcattgtagagaagctcaagaacttagtggtgataccaaaaggatgaagttggtatattgatattgtgaaaaggcatttgctggtggtgggatcaatcacctcaaacaacatcttacaagagtaaaaggagaagtagaattatgctacaaggtgccggcagatattcaccattaaatgatataaaatattcaagctattggtgagaagaagaaaaaagcaaagataatggataaagattacaatctctttggtgcaaggcataaggaacatgagaaacaagtatattataggcaattgcgtgaagatgatgacatacaagaaattcttcactcattaaacaagtctacagataatgcaaaaagtaaaaatatagaaggtgaaaaagaaaaataattaggaacatttgaaaattattcatgctaagaacaacttctggtgttcaaccaactattaaaagcttattgcaaaacaaagaagcagttgaaagttgtgatcttgcaatggcaaaatggaagatagatgcatgtgtgccatttaatgctgtcaactctaagtattatcagtgcatgatagatgccatagataatatggggcctgattacaaagcttcaaattttcattctgttcatgggttatttattaaccaggaatgttgatgaggtaaaaagttatattgaaagctttcgtgccacatggaagaaaacaggatgtacaatcatggctgatggatggacagatcagtgtaggagaactttgatttattttttagtttattatcctagagggatcatatttttgaagagcatggatgcttcagatacttcaaagacggctaatatgttacacaagttattcaaagaaattatcatatccgttggttctgaaaatatggttcatatagtgactgataatgctataaattatattgctgccggtaagaagttggagcaagatttttctactcttttttggtcactttgtgctactcattgtcttaatctcgttatgcaagacatcgataagttagtttcagttaagaacacagtagcccatgctgcagatatcataaaatatgttataatcattgttatcctttgtatttgatgagaaaatttactaatagaaaggagattatttgtccggcacccatatattttgctaccaatttattgctttacaaagcattttggaccacaaaagatatattaagagcaattgtgacttctagagagtggacaacttcaacttatgctaagaatagtaaagaaaaaaagctcgctgatgatgtgcttaattttttttttttggaatgaatgtgcaaccattgttaaactaatagagcctttaaatcgagttttaaggattgttgatagtgatgatagactttcaatggactacttgtatcatgctatgcatcaaactagagatgaaataatcaaaagatttagaaggagaaagactgtagttgaatcttatttgaggataattgattctcagtgggatttgcagttatatcaaaatcttcatgcagctagattttggttgaatccttatttccaatatgatttagaatttatgaataaacatcctcgtagtatttctagactcttagatattatagagaggtattcatttagtaatccgaccttgcagggtaacttaactaatgagatgagattatttagaaatgcagagaatgactttggacgctcatcagctatacatgatcgaagtcgctagcctccagataagcttgttccttagttatgtctttatgctttcattgatataaagttttttcaattgcattctattttaacaaatataatattttatatctggatgaatggtgggtcatatatgaaagttgtgcacctaatttgcaaaagttagctattcatgttttaagccaaacttgtagtgcgttcggatgcgagagaaattggagcatctttgaacatattcattctaaaaagaaaaataggttaaagtaccaaaaacttaatgatctagtatttgtgcactacaatttgagactacaataaagataattttattatgaatgatatccaattttttttatttattttttattatttaattttcaaactaacaaatactaaatataggttttatttcaaggtcgcaactatgatcctattgactttgaattgtttggtgataatgatgcatgggtattagtcgataagccacagagttaactagtggggaattagcatcttttaatcatgaattggcatcatgttctatttaagaaaatgataataataatgagcgaattattttattatgtaatttgtaaataaaatatcattacaatttcatgagatatgatttttttttaactttttgttaaatttgtgactttgtagatatattgaacttagaagatttggattgtgatgatggtgaaaatgatggaaatgatgttaataggagaaaagataaaggagatgaaaatattgcaagtcaagaagatatttttacgaatattgacataaatttcagtccattagcttgaatttctatgctgtgtacttgtttatcacttttaacttttttttaaaaaaagatattgaagtgaaatatcgtatattattgtgtacttatttgttaaaatttttcatcttgctagcagatgtggatggttatattttaaagttggattatatgtttgtgcttgtatcaaattttggtatttctagatataaggttagcagttggttgagttcatatatctttaccagcttcgtttgtgtgattgaataatgcatgcttgctaactgctaagatttataaattcatagcttgttatctgatgaagctttttatgatttatgttattgtggatataatgcatgaggtaccatagatgtgcggtgggaatagtcaaataagtttaaactagtagttaagtagttattataaatttataactttatatcattaaatttttatatttatgaatattttaatctagttatttatatttatgggattatagttatgttttatttatattttgatatgaaatatatataatcaaaattattattaaattttgaatataaataaattattaaattttatattttatgtattgatccatcgatctagttgtagatctggtggttgaatcattaattcattgatctgataggttgttcgggtcaaagtcggtccgaatataataactttggatcaaatgttataaggatcaccgtagaacgtatgtttttaatgcgtaccacgtgtaggcctctaaactggggccttttagcaatcgcacgagggcgcgctgattgacagggatgggataggacctacagctttatttgggggacccaggatcctccgaactctgcttggggacagaagttgatggcttcgggatagcatcacggcagccaattcgtttaacctggtaccccaaaatatgaaattatctgataatataaatattaaaacaaagtggaaagatgatgctgcatgtcattcacgagaatacaatgctggcgtacaagtgaggaaagatttcagagctgtaaaattcgagttacggtgaagatacttacagctacagtgggaaattaaggagccggtcgctggggtgtaaaatagaacagtctgtgtggtgcctgctagatatgctatccactgcacaaagttgttcaaaaccaagggagaggatgaaaggagctgggaacttcaggagagcacaaggtaacagatgctgggaatcaaaattgcaagtctcttctcttttgttcactgcacatatggtagtatatattctgcattttatctgcagttcggtcgaatttttcttccttactcatcaacagatgcttaaaccatcatctgtttgagatgttattgtttagattcagatgctgagcaaaagttttagtatggctattctgatgtttcatttactaaagcatgcaaatcaattggattggatggtctggaaacatgccatgaaaacttcaactggtgtcttctctttctttaatttcttgctgacaggaagaataatggaaaataaggttcataaacatgtggtgaactcttggttaatttatgacaaaacaggagaaatgcaggagctggactctgcaaaccatgggggaaagaaacagtggccaagcatgacacaagaggaagaggacctgataagcaggctccaccacctgctaggggataataggtaactggtacccatctgtcattttatttttgatgtcttaacccttaaatctttcaaggaaataaattaaaaagagaaaaataatgaactcgtttcttgcataaattaatcacaggtccctttttttttttcttgtgaagtatgtatccaacacaaacaaaaggcgatcatagatgaatcatatagatatatgagatcaggagatttcctttttcccttccgctcaacaagcgtaaaaattactagcttttgcagggaacgacaatattaatatttaagaggcatgattttttattgaataaagggaagctaaaaaggagcccccggacttctatgaatatatggataaaagcatttagaacttgggagagggaacaaaatgagttagaaagaaataccaatgaataatatgaatccgaatccatgaaccctgtaaagcaccaaaaaaaaaaaaggaatccaaatgaaaaaaatcagacaataatatgaagagagttagaaatattctttcgtaggctgcaggtagcttcttttgattgcatagaataggccacttattgaaatcatcaggccaacataagcaatagaagtgatggaggattgcttgttaaaaaaaaaatccgtgcaatatttctatgcttccaaacagctagtctagatcatcaccacgaaaaacatgagaataataggctgaaatttctaaaaggaggtttaagatgcatgatttgataatatcaccttcaccagatgggcgaatatgtttgccaattacatctacattgcatactaaaatagattttagcgaacacttaacctggaaaagtggtgcgcatggaccttttatcatttcttaattgttcttcaaatatttatttattgttttttccttttaatgtcaggtgggaactgattgctaaaagactgccctgcagaacagcagaagaagtggagagctactggaaaattaaggggagaggagaatttgagaacaacaagatctataagcctgtctgtacgagactgagtccatcctttaagttcacaatggatgaacccttggaagatacgaaaccatcacaaagtggatcttgaaatacaaggttccttcactcctttatttggacaaataaatacatcgcacgtcgtgaacttcttggtcttagaatctaaaaaaactttgcaccaccaaccgtaccctgtataagttatcagttgatccatcttaatttattgccgttagctatgtaacgtttaacacttgtgcttctttagatgctgaactgtcgagtatgttccattttttgaagtctactttattccgatccataagatcagcttcatacttctagtaaatcattgaaagtagttcttgttccaacaaatatgaatcagatagcaaaaaaacatgatgcatgttagtcaagcatccaaatgactttagttatgaaaactttcatcaaaatgatcatatttatttatctcaatccctaacactgtcacgcttcgaatctaatattcggatcggacatgtgatggccgcacacttcttagagcaaatccctaaagaatgtgcaaggcctgcctttacatttaaaaatatcacatcaaattataccagacaatggtattaaaagtaaacctctaatctatataatatatataataatagtaaagtgatacatgggtattaggggcggtattgcatgttgacacgtaaggttataggataatcttccgcaatgccatgtgtcaaattttattttttattttttatattttttaaataaaaataaaaatatattatgataaaaaataaaaaatattttaaattattataactcaattttattctaaaaagagaggaaaaaaaaagcaaataaagtcatggtcattaaaagccaaaactctttaccctctttctaccccgctactaacgctgcctctgaagcttgtattgtctatctatcttcttcataaaattgaatcttggtgatgccaaccatggtggaaaggtggaggaaactcttcagaagtaaatgaaataatcatttgcatctgactccatggtgctcgagtctccacccaaaagatgccaatgatattttcaagaagatgaagaagatggggcttatgcctaatgcagttgccatgcttaatggacactgcaaagatggattggttcgaaaagtaatgaagctatttgcattaatacaaaagaaggaaacaatctctaaggttgtagttcatacgatgattgtggaaggcttctgcaaggcagcaaaatttgatgatgcaaagaggattttcaaaaaagatgcagaaaaatgaaatatgtcggatgcttttagctatgcagttctgattcagggcttgtgcaaagagaagaaattggaggattctgttgagtactatatggagatgttggatgctggacatttattaaatgcagtaaccttcactggtttgggaggctatctttggaaaaaagaactctcagagattcttttgatctcatcatagattaattggtgagagcaacttttaatataaaatgttattattattatcaattaaatccccacaacgtgcaggttgagtgctagttttattaattcaaataaaatatatatcaccaataactcatcataatcaagaccaatatttatttaaaaataaattaagcaaatatcctctaagatcttatgctcctcattgctcaatccaaaattctatagaatcctctggatctgaaaaaatatagaaaagagagggtgagctttacagactctataagttatcaatatctctgagagttcaagtataaataaaaattctttttcaaacatacaataatagatgcaaatactaatatatttaaaaataaaactatgccatgtgtaacagcaagatctaaaaaaaaatctctcccaatttttgttgtctatagccacaatcagtcccgtgataaggtccaggagaaactaacccctaaaacagaacattcgatccatcgatgtatatcggtgaccagccccactatctaggctgaggagagaattagctctaattcatacggtcacgatttaccctatgacaaggcaaaaagattagttctaaagtaagaaacatgcgatgcatcagtgcgtaccagtgatcagtcccgactggctaggcccaagagaactaactcagctagcgattagtcccaactggctagattcaagagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatagatcaattagattcaaaaatcatagcctttgattcatggtctgatccttagatctgcacttctcacgatatctattttgacttggccaatatggaaaagagagagatactcagtctagatcatgatttggatagaattgtgggacgaatctaaatatctcagatttgtctttttggttctttttcttcttctttgtttttttcctttctctctctatctctcttttttctcttttccctcaaatctctcattctctctctactcttctctttccttttttttgtccttccctctctctctcgttctctctctctctttgttctttctttctctcttcccaggccgaagagatggcattcctcaaagaaaccagggggaagatggaggggtggggtcaatgatggtggtgcggcagggtgctagcaatggtggtggcttgatcagcattaccggtggtggaaaatcggcgataataatattgaaaacaaaggaagtagcaaaaattgaggagaaagggggttttcggatgacgacaacctgcttgtgaagtctaatggctgtcgaaggtgaggaagaaagaagaggaagagggattttggtgggggatcaatcaaaagcagggtttaaatagagaaggagaaaagaactgataagctcaatttctcctcgaataaagctgaatctcgccgtcgtatcccatccaaacactctttgactaatttcacttaatggtgcacggcactaattcggccaccctcatggcttaatctgccccctaaagtcagggattggcaggggatgtggttccgctttttttttttctgagaagtcctcatgaaccgggtccactaggatcggttcttacattctctttccttaaaaaaaaaaaaattatcctcaaaatttgagaaatctaagtcttccaaagttaaagatgctcaacctaaacttacatacaccaatttatcctggcttggcatttttgtcaaactgaatatatgatcatattataagatgcccgcaagcaaatccaacatcttaggtcaaccacattaatgctcaagcacatatctacacctaagcatggactctttccaagaataattcacaatttggtacctccgcatcgattttgaaatttgcccccatgatatacaatcaaatatctcatctctttttgatcaaaatcagtgtgattactaaatcagaagctttcaattgcatttaagattaagatatagaccaataaaatcaacactaattcagtaatcgagactttgagattaaaataaatgcatgttcatttaagattgagttgggatcaattgggtgcaaaaagtcttacagtaagatcgattataaaaatcaattgtgcttggaatagagcttgaaataaatttcaatacaaatactatgatgatgttttgatctcgcaaaaagttaatgacccaccttgactaaaattaaataatcagataactgtgaaggtgattataattatgttgtaatggctataggcaataacgatccatcaccattgagaaaataatctcaaaattgaataataaaaattaaatccaagaagataaagtatctttatcatggttcctatgttagagttgagatcataaggagagaataaatcaatctagatttgtttagatgcttgatatatagatcaaatttaattaacaatcaactaaccttggatataaaatggatgaaacttttcttaacacgatcaatatagtcatgtcgtaactagcttaagaatccattgtactcacattgtctttatgattaaaagcctattttattgaaaaatcatatcttccatcataatatatttcaaactataatcaatatgtttgatcaattttaaatgactcaaccaccatacttctactgtgtcactccaattaaccttttccaaagttcttaatgatttagattatagttttgtaaactccaatcaaatattttgtttttctaagtccattggatcataattctccttcaaaataattgccgtatttacactattgaatgattaagatagtaacttctaaatttgatttgagtcaagtcaactctagataattactttgacaattcaattaaatgattcaaaaatcagtctatctcttttgaaaacatcaacttctaccttgtctatcatgatcttgtaaattactagagcatggtaattagaaagaacagtcaactttagaagatccactcaaaatatcagtaaaagagattattcttaataaaatatccttccattgcttagatcttgccatgattatagaagtctttcatactcccaatatccttctattaccttctttctattctctttatcaacaaaataattttcaatggattttctatgatatcaagattaagttcccaaaataaatccaatgctgatacaacatagtataacccatctatcactcaaattatacatccatatatcaattgtttagtcatgatttatattctttctaaaactagacttgaagtattcaaccaaaatctgaacaatataaaccttctatacttatccaaaacaaagttttaagaaactcaatttatatccataaaacaaaatcagacactatgaaacatatcattatacttctagtaccaataattatttttagatatttaatcaaaaccctaattctatcccactctcattaatctaagttctcatgatctgaaacctaagctctgataccattctatcaagctctgaatctaatatttagatcggacatgtgatggctacatactccttaaagtaaagtcctaaagaatgtgtaaggcctgccttcacattcaaaaatatcacatcaaatcattctagacaatgaaattaaaagtaaacctctaattttattgattccaataaaatatatatcatcaatatctcatcataattaagatcaatatttatttaaaaataaattaagtaaatattctctaagatcctatactctttactgctcggtctcaagctctatagaattctctgaatctaaaaaaaaatataaaaaaaaaagagatgagctttacaggctcagtaagttactaatatctataagggttcaagtataattaatttttttttcaaacatacaataatagatgcaaataccaatatatttgaagacaaaactatatatgccatatgtaattgtaagatttttaaaaaaaaatctctctcaatcttcatttactacagccatgatcaatcctgtgacaagattcaggagaaactaacctctaaaaatagaacatccgatccatcggtgtgtaccagtgatcagtcccactagctagatcgaggaggaaagtagctctaattcacacgactataatttgccccatgacaaaataaaaaaattagtcctaaaataaaaaacatgtgatgcatcagcatgtaccagcaatcaaccttgactgtctaggcccgggagaactaactctgccagcgatcagctccgactagctaagctcaggagaaatatatttctgacatgtggccaacgatcagtcctgttagctacacccaaatcatagtataattatagagtttttctcatgattttatcataatcaatttttcataaataatcatacttatttttgtaacagtatcatctcaaactttcatatcatcagaaagagccataaaatattttttattcaaaatttcatgcgatgaacatgtataagtttcttctcagaaatcatataacattaaaataaaaaaatcatctctttttaaattcgtaatcatgaagaggtgatgccatatttgatccaattttgtaaattacttttcataaataaatatataatttaaattttaataatttttaaatattttatatataaaaattaaatttttttaaacatataaatatatataaaaaataaattcaaagataagagagaatttacagttttagatcaattaaattcaaaaatcataattttggattcatggtctgttccttagatttgcactcctcgcgatatcaattttggcttggcaaatatggaaaagagaaaaatactcagtctagatcacgatttggacaggattgtaggacggatctaaatatctcacatctatttttttttaatttttttctctctctcctctcgaatctctcattctctctctactcttctctttctttctttttttttgtttttgtccttctctctggttctctctctctctctcttcttctttctttctttcttcccaagccgaagagatggcttttcaaaacggagggaagatggaggggtggggtcagtgatgatggtgcggtaacatcaaaaacatttgttatcattactatttacaatgtaataatacattatactgattttttatctatctccgcacccacctgcagggaccagaaagaagggagacaacttaatccctttccaaaattcagaaaagataaaaaaatatatctaatatatataattaaaaattatttagatatgtcagagtcatctaaatatatcaaaggtatatattttaggaagttgtgttgaagttaatttcaaaattttttcttttcaaaaatattttccttcactcatacagaggaaaaaaattgaatcagagtttttttagaaagccctttaattatttaggaatctatgttaaaattaattagaaattttttcttttagaaatattgtcccaatttttttaattattttaggaataatttcttggcagtttagagtgtacataaaaaagataggaatattgagctactttagaaagctgttgattatttttatgtatatagaagaaaaaattttgaagtaaattaatttgaataggactcttattaattatattaaaaattattcatcatttagcatctttatatctctcaaccatagccaatatggtagatccaattaaccagagttcgccataagcctgccatgaaaccatcatctcttgaccaattagtttctcatcacgtggccaggcttgaggtgcatggacactataataaaaagggaggtaggtgagataggcgatagttatttgctgatgctagaagggggcaccggtgggttgtgcaacaatattaggactttgtgatgcttttaaagcatgtcgaagaataacgatgcttttaagcataggaaagctttacttattctaagacaatgcattggaatgttgttatcttaaggtgctttaaaacatcatatcggacgccaatcaataccccaaaccattccatgttggctcttaatagaaatatcaagttatttgattcttccatgcacgttatgaaggtcaatgtggtcaactgcctagatggagagggaatcccataaaattttaattaaacgaaatgttttacggtcagccatgttggaaggtacatctaaagtcctgcccaatgttatagaaagttctgcacccatgttcttaatgatcagctccacatggattcatgcacattggctgctgacagatgattggaaggcccacatcacatgccttgatatgctgtggttcagtcttatcagcaccgggggtcaattatctactcaattcccatgtccttgaaaccattcctggtctctgtcttctttatattagtacctttcgatatatagatttaatattagtacgtttggatgcatggatggtccatgtctgggcattggatttctttactttctggacttctaacaattttgctttttcttttttcttcaatttctaactttccatcaatccgaacctgccaaattcctcttaactaatgcccccggcttgtacaaaagaaatcattgttgtgattgtttagtattttccaccgatttatgatctaaaccatgggttgtgtgtcattattggagcaccattagcagtagcagaaaaatatgtgtcatgtcagtgatatgtgacttattagcaaaatattatcttttaatttagtagattttttggtaatgtaatgtatatgatcttgcaaccaacttaatccaattaagataatgagtaaaataataattaactacaaatgcaattaagatagaaatggcattgataatttatccttttatattttttttactaaatgcaacattaaatatatattttctttcactttatataagttacaattttagtcatttttcttctacaatacacaaaaattggataaataagtcgagatccagcaaaaaatatttagatgatgtttaggattttattaattttgctataaaaaacctaatataaatgagaaaattctatattcatgcagaaatgtgtaaattattcttctctcaattcacaaattgttgaagaatatttggtgtggaataattttttgaaggattatactggataggtatttcatggggagtccatattatcttttgtacaagatatcttgtaggtatagagataatattcgatcaacctcaaagaaatttatacaatattaccaaaaatattgaacattataaattctcatcttatggaagagttttgggaaagatccaaagtattgttcttggctaaaaatcattggcacaagcacattgttatgtcttacttcatagtgacataaattatgagtattgcaggttagaatacttataacatgattaaatttaataccctatcatatataatatttttgactaatgatttaatatttatataatgagttcttggttgctcaatgatgaggcaacaataacattcatcggaaccccaagattgagcagaaatggttgattcagccattccttggatgacttttcaaacatgttagacatataacatagatatacgttaattatgataaatattttgattaattgatttatagctaattgtgatgttttttaggtaccgatgatgatgaagagtaattgttcagatgaattgatagccatcgctcgaggtcctaatagtattatcaatagatataatagttttattatcaataattttaaatttcatactgaagagaaaaaaaaatttagaaaaatctaaaatagtagagttatgatagaggcagacaaaaaaacttattgtggtatggttaagatatttaagggttagattactatgaaaagtttaagatagtattattttatacgattgggttgctgttaactcaccaagaggtttaaagcacgacacaaacaagtacgcacttataaacttttgaagattgatatatattggtgtactattaaatgatgatgcatttatattttcatcttaagctcgataagtttttttttctacaagactcaaaagataagaaatgaactatagttatcaagatgaaatttagggacttgtatgatataaggaaaggaatagttttgaaagataatgagacatatactcaatgtatatgttacaatattatgccgactactgaactaaatgatgtttgactcctattgataagaatatttaagatatatatttttatttaataaatagtattcattattagcaattcatctattattgtatttaaaatttgtattaactgatattgaattaattcatgcaggttagaaatatcgatcatgcctcaaaaatattttagagttatagtgttccagcattctcaaattggatcatcttccattcagccccatgagcttcaatagtttgaggctcacccttcaacactccagtagtctcagtagctaggatcttcatcatctacaagcacgaacaactactaatgatcgagacaaggaacttgtggtggatgacttatagatttaggattatttaataaaatttatttcaaatttatttcattgtgtatgatgcatatttcaaaattttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatttaaatatatattatagatgctattttatgacttctcattgtataacaagaattttttaatttttgtaatatttattgtatttaaatgatttgtacaagatgcacagattttgtacaaatatttataaaatactattttgatatcttttttctaaaaaaaaataacgatgcttattagcatcatagaacacgttagatgacaccttgtagcattactagtaaatattagtaaatgatgctcataagcaccgcccacttagaaacgttaattagtgttcgtggtttgtgatgcttttaagtgtttgtagttccttacaatgctttttaacagcattggcagattccatttcaatggttgcataggtgacgcatttacgatgctttcataagcatcatggactaaattcacgaagtgtcaggatggtccaaaaaaaatactgacctttctcttttgtcctatggtgggagatgcctaaatctcccgccactcggctacaactagcctataatagtaaaacaacttccatagtcatgagatatattgagaaatcatatacacaatattttttaaatgtgcaagtagttatctaaatagttgcctcatatatctagagctatcgatttgaattggactcatcgagttgacccaccccaccatataaataggacgagttggacttatattttagcaatccatttaaaagctggttaaatgacccatccgtttggattgtgggttatgatggattggggcgggtcgagacggactgacccctcttgacaactctatttgatgtagagctgtcaatttgggttgggctcatcaggttggcccaccctgtcatgtaaatggaatgagttgaattcatattttaacaatcaatttaaaagtgggttaaatgacctgccccatttgggttgcgggttgtggcaggtcgggacaaatcgaggcagatcggcccgtcttgacagctctacaaatgtctcaagattctatagcgataagttttggccctttcctatataaaatgctccaagagatttctccagataagtcaagtgaagctaagccaagaaaagtaaaaggaagttaagtgaagtccatctgagactgaactctctttcccaaactttatttgctctctatgctacttacatagcacctcccttgtttccttggaagtcatctatcttaggtgtcagaggatcctccactggatactttctaataaatagacttccttctttataatatttcaacaccgaccgtcgtattagagtgaagatccaaccactatcatccatcttccaagatcttcagctagctcctccaatccttgcatcaccccattaagtcctcacactagctagctcaacaacctagttagactaatttttgactgcaacagcatctatataccaaaaagaagaatataaaattattttagaagattgttaactaattccccacctcctctttgtcttaaattgaaagaacttgggttagaacatataccttgagcatttttgatcccaaaacaagtggaagtgattatatttgaacttgtttgaaggccctcttgtcctgcactccaagaaccacagccttgtgccttcgttgaatgcactccaaattccaaaagagagctactaaagtcctcttatggtgtccatgccttagatacccaaggcttttttagatggttgtcttggagaaagagagaaagtataacaggaagaataacgtgtgtgtagttaagttgtatgtatagtatgatatatgactgacatacaccatctatttatagaagcatggaccacaatcccactctcacatgatctctgtaattggaagttttttgaaatcctcaacatccacttaagataaaactgagtcaatataatccactaggatatgactagaatttttaataattaattaattaattaattctaatatccacatttgcatacttatctcatgtagatgtattggtattctatatcaatgttaataatctcccactcggacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccctgtaagaatttggatgaggtctacctgtaatgggagctcaggactgaagtctgactcccgtaggagctcggacgaggtctacctgcagtaggagtttggaaaagaagtccggctcccgtaggagcccggataaaacccagaaggtggtcgaccgccgtagaaacttgggtggagcccgtccgtcatggagatctactgttagaaaagttcgaccactgacgaactaatgtagttctggaagaaattcagattggagttgatcgaatcctgtcgaaaaagattcggaaggggtctggagaatggttgacccttgtaggagatcgatcgatggtagaatccagaacgcacttggagcagcttgatggacaaccgaagaagcttattgttggagaagcctgggagatgcggcaggagtttgtccgtcgggggaacccgatcgacactcgtggaagaacctgtgggagtttatccatcgatagaacttgagaatattgcggaagctcgaccgccgaagaggttcgaaaagatgtcgcccaagattggacatcggtagagtcccgggagagtcactcctggtatgaacttcggctggagaggtattttatacccaacactagtctccctactttcgagttcgagtttcgaatgaagtatagagaaatttttacagccgaagttgcccccttgaattctgcgcgcgaccgccctcagatatcctggcatttaatgcgcgcatgtcggagtcttttcaaatcagagcgatccgaagatatttttttgaaactctcactggagcgttgctctaagtacggcgcaataatggccttgccagttgtcagccgcttttagccacctactgtggcgagtgggacacgtggcgaacatgggtcgacctgggaaaatctgcgatcattatagcgccggatcccaaggtctatttaaacccgcccttcttccttcgggagttccattctgcctgaaagtcctattggtgcccgtcttctttctaagagctctgaccttcctcgacgtccgttttggccctaggtgttcatcgagtcatccctgtccctgcatctctacgtcctccgaagcagcttaggttagttccagaactttcgttccttctctcgtcatttaggtgttccttcttcttcatttttcttctgccgtattccacctgtctagttccccatggatctttcgtctcttatttctcccgacttttctgagatttttagggttttcacttgaaatatcttctggcacctctgcctctaacgatttcaggagttcgtctgcctcagtccctcagaaccctcatactgtagatgaacccatatctagggctggacctcatccagtttttgtgccggacgccatttcttattttctgactctggacgaacttctactgataaggattcagtatggagtttctccagagtacgatctggagcttcctgatcccgccgatcgggctagcacccccccacctggccatttctgcctgtactaggaggccttccgtgttgggctccggctcccacttccatccttcgtcgtcgctctttttcgtcttctagacatttctttagcttcagtcgcatcgaattcctttaggtttttgataggattcctctttctttgccacatagtcgaagttcaaccatctcttcctttgtttagattatttttataccttcaaacatcatccctcgacaaaagactggtggtacttctccccccagttcggcaagaagggattgctgaaaggtgctccctcttccatccataactggaagaaaaagtacctctacgtccaatgtccgaccttaaagctgggattgcccccttggggcatcctgagggactccgtccgtcgggctcctagcctgggggaggacgaccttcaagccgcccaaaaacttcttagttatccaactccttctcttcccaaccttctgaaggagtaatttctgttcaacatcggcttgagtctcttggattctacgagtattccatctttccttttcttcttcttttctttttctctcccccttcttctttttttttttaaccatgcgtcacctctttcttttttcactctattgctgatctctttttttttcttttttttctttcttctttttttttaggaatggacgccgaagcagtacggatgcttgccaagggcctcaaggttcataaaagaaaaggtgctgcggcctccgagtcggcaaagaaggccagaatggaggagatgagctcgaccatgcctgcccaggtggccctcattgtcgatgttctttcagatgccgagccccccagttcccccgagcctcttcgaggagttctcccagccgaggttttcgcttcgggggcccgctccgaggaggtgccaggggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatatctttcgaagtatttggttcgtaaccagaatcgaaatcaaaatatatttgaatccttagaagacagataggattagattttattggaccatttccattctgcccaggaattaaaattagaatcgaaatctccctaaccaaatgttagagtcatccatttttcattcccatttcaagccccaactcccctccaattaaataccactaagttttttcacaaaagatgactcaaaaatctatgatgtccgaaccttagtagcaagaaaggcaatgtaccgtttttttagtatttgcttgcttcaagtatttctaaaatatctgcttcccatcacccgcacctattctagctcctggttttggcaactgaactcgtatccataactccaggttgaccttttcgtttaaactattgaaggactcaaaaaggttaaaaggatagttacaacattgtaataataactccagttccaaaattggtcttaaaccaactataatctcatatcattatcaagtaacttggttatatattgccagccacccttacatattgggatggttcaggattctcctcctatgagcttaaatacattgcaccatgttctaataagcacgtctttattgcatttcctttgtgatcaccctttgaatttacctttaaggtgcatttggttggcaactggaatcggaattaaaataagatttaaatacttaggaagagaaaggattgtgttttgggggattgggatatttttattctctcctggaattggaatggaaatagaattctctacggccaaatgaccggaatagaagtcactcatctccatttctattcctgggtccaactctctccaaccaaatatatcctaaacttagatgtccaacaacaataacattcaaaacaattgtaaaatccataggaatgcccaatgccacatctaaagccccaaggaatctcgcaacaatctaaacccaaacaatagtaatccactataaaatcccaactacaactgctaaactggcaaaacctccattaagcacagccttaatcatctcataaatccaataacaagtacatgtaactcttagaaataagtaaaacccaatagtaagctactgctgatcaatagctcatatactccatattggacataagtatgagtagataaatcccatactatcttatgtgtaaatgaaatctctcagcttccaaagaatattttagctttccatatcttatgtgctttgatatttgaatatgcctggtccccacccacatccacacgcgcccaaaaacaatggaaaacttgcattaggctcttccactgcaagaagatcattttcaaaatttatgatcttagacttcaaaaaaattaaaaaggactcaaaaaacctaaacctcacaacttcatggtaaaaccaaatatataaaccacatgcatattctttgagcctttgtcttagttatacaagtagcctatagagatcctcgtgggctgacaaagtgacacactattgacagttctgccaagcaatcctttggcactcgatcgtgttcaacaccggatggatattctcttgcttgcattccctgcatggttttcagaaacgatgaagacgtagagaaaaccacaaaatccatgacatgtcatgcacgcaagagatgggtcttggttattgttcaaaagtcatgcttgttaactagattaaccaatgcaagcagaaattctgggacatggactcgtctatatccaccttatttttcaaggaccctaaaggaggagacagatcattattagtctgtcatattaccctcttggatcatagtggcatggggatggtctcccttactgtttggatcctctcacaaccatcttcaaagaaaaggaaaaggagactgaggaacaggattgctttttgattacatgctcctttaacattccaacaatttgtgctttaacaaaatatatttcttgcaattcctgaatgtctgtatgatgcctggccaagcctagtattacttcaatcaaacttgatgctgccttcatattctctactataatctgcatctcaccgacaatgcagattttaggagtttgcagatacttgatgattataaacctgaaattatataggaaaaagggagaatgagaagaaaaagtacaagaacatagagaaccttgaaccacttggaaagagaaagccactgatcttacaaaaggcattctatgtgtgaatccacttgaacttctatcatacctcaatttcctggaagaaaatttatacaactccattgaattctaggtgacaaatggagaagcaccagtataactgatctgaaatagatagggaattatcttcttggtgttcttttttgtttgtccagttttcatgctttttttaggtggacaatgttcatgtagttcaaagttttctcttgtacctgcacttggtggacaataattaagtccggttcaatggcaggtccgttttcaaaactcattctctccttcttcagttatatttatacagaatgttgtttattcctttacagtttcatgagaagtgagagtttcataaggtcatgctatgggactttagaacataaacaagaagtttgaaaattcaagtgattctaaaatatatgtcttataaaatgataaacaaaaatcagagtcttccagatagaaacaaacaggcttaccaaagactattaacagagaattggcactagaacattcagagacccaattcaccaaaatattgtctcattgagttgtattaagaatctgctcctggtaccaatgcagtatatatgagaacatagtagaggtcctctaccacccctacaatggaggcaattgcataaacttatgccaaatattttaccaatgttaaaaaacttgacatattcagagagtaaaatgattgtagagatcagtcgttcagtactatctgatgcacacatagttcgcatcaaatcatataaaatgcagattgattcctatcgtagtttcgcaagaacattgttgatttcataaatcaaacaaaacacagaaataagaggacaccaaaaattagacagaaaatcagaagttaaattccaaaatggggggatacaaatgatgtccctagacagttctagaagtaaaggatacagattctagcaagaactttcaaatgtattttttcacatacatttgtaaagcttgttaaactcagaaaagttgatggtgcacattccaaaatatagctaaaactctagcatcaaatcatataagaaaacaagaacttccaaaactcggacaagacacatactttccatgagaatatatctacaaagctattctgaacttgaagaagctgacatctcaagcgtcaaactaacaagcttcaaggggattttggatgatgtatgtgcatgcctgcagatctgcataaatttgcatatcatatgtgttaatggattcaaatggatgaaaataattaaaattcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaaaggcgaatttttattaaaaggtgccaatcaagccattgagatggcatcccagcagaacgaatttttgcttccaacgaagtgatccagatttaaatctcaatgagtatcagattatgattaaatgtcaggatgtgaatgactgtgaatggagtatatcttgatggtccggacacgatatttgatccgttagctttcaataatattgggatgacgtatttatccgttggattcatccatatggtgaaaaagagaccgtttattcatccggctcaaaattagatattttttaataaaaattgagatcctatgatcgcatcgggagaaagtggatgcatccgattgcgtccctccaactctcatctttcctgtcacaaaaaaaaaaaaaatgccaaccaaccaacacaaaaaccaaaacattccgggtcacatttcttgtctcttctttggtcatcaatttattatttcacgtgggctaaaacaaaataccaactcgtttgttctttctagaaacatgtcctcaggattaaacactcacaaagataagcactaaacaaaaatgacgtctccatggacaacccatcattgcgtccacccaatatatgctctccatcaacaccattagtcctcgatcaaacggtcagaggatgtttgctcggaacttttagggaacaagggaattccgcataatggtaacgtctcaaagcacgaacgacggaagacccgtcaaaacgattccggaaaacgacagctttccgttggagaaaatcctaccgtattcatcgcggaagatttcctccccttcaagacaaggtcgaatcctctccatctcttctcgatcagacggatcaaaaaaaaacaattatggactattatcataagttctcaagtcaaagggactgcttctaaattatgtaccgtcatatacgacaaaggaaacattctaatttccaatgaaggcagggagcaaatcggaaaaaaaatcccgctctgtagtaaaaggccccaagggccaagaagctcttcatggtaaatagaaagcggaattcctttggaattctactttcgttcttcccctctttctcgccggcttggtggagtctctcttcacctccgtttcccctccatctataggttttggtgagcttttcttggggtttggtgcgtattctttgggttttcggctcgaattcgaggggaagtgatggatttgtgacccttggaggagttattaaagcaatccttcgcttacattcttgcatgcaagaaaagagatggagagatttggtcttaatttggacaaaatcggaaggtcttaattgataccaagatcccctcctgctggtggcggaactggagaatctccgggcttggtcaccctccgacgtgatccacatcgaccatcgcttcgtcgcccgcttcctcacctctgcctttactcccttctcatcttcttggacgccacccaggtccgctccaaacccgacctccgcttcccccacctccgcttcgagttcgccctcgtctccttctacaccgcccaccacaccgcctcttgccacgtcttctctgcggcatcgagtttcaagaatcctacgccttggtctcgggagtgctttggagtttggttccgaagagcttagggggaaaggaagcatctttttgaggtctgttttgtggttttggtgcgttttgggaaggggaaagggataggacagatgaggaagacgaagaagaacaaggaggagatagcggaagactactgtttcacttgcaaggatggaggacatcttcgagtgtgtgactacaagtgagctcggtttttctccttctattattgtagaaatttgcttaatgtttgtattaggtttcctttatttgatcttcgtctctatttctctctattggtttgtatatatttcaaattttggatatttgggtgtgaaaaatatgacatgcattttttttaatatttataaatgtttcgatattacgtaattaaatttctgctcatttttcccctttttcctatgccctacaatcgtacctctggagaaatgtatgtgcttttttgagtggggctgcttctctatgccccaccagttcctactgtttagcccttcccgtatggtgactcgcatgctagttttgcttggtggcacggtaaatgttgtgctgccagtgtttcctcaaagtagtctttagcatgcctcctgcatgaatttcttgtccagttgaactgcaaaattagtatgagaaagttgtagcagtttcatcggcattgtttatcttgtgtgcacacttcaagcattagaggtagcatgtccatttcttacgtgacactcgagcatgcttttgaccattccttttttactgttacattgatcataatacaaacattgccatgttctttgggaacttgatttctgcatttagcagaatgcagactcaatctgtctatatctttaattaaggaaagtcactgctcatcttgcttgatgtttgcttccaatgtcgggtaccatgaagaaatgcacctgattatacgccaactgttgttcatgttgatcaaatttaacaaactttcatgtattgtctattagttgggtggcttttaaattataccttcaattgaaaattttattggtcatactgctctttaaaaacaaacaaaatttatgcagagtctttttataaacctttacatggaagtggcacacctccatattgaagctaatgttgtataacatccaggcgcacattcttctggtttttgtcattgtccttgagttaaccaaagtttgtattgttgtacttcttcctcatcttacgttgcatgttcttaccattctcttccaccatgacggaaagagaccaaaagaggaggggtcccaattgcatgcattgtattatactagtatttgcatgaatcagttcaaacaaaaggtactcatctgagcagagaatctattaatgagtttttatttttgacaaggactcagttttaatattgctttctgtagtttaatttcaattttctgcttgaaactgttaaaaggaggggaattatttgagtaaaattctaaaaggtaaagataagagcttcagtctttcttttttaaaaaatgacataagttaaaaatatattttaaatggtttgggttcaaaaccaatttgtgtactaaaaattattcagaattaaacatattcagaaaaaaactacagaattagaaaaatgggaaaaatttaaagtgtgaaacaagttaaaaatttattgaattaatttcagcataaaatattctatttgatgataaagtctttatatagacagacaagacatataagagataactctatggcttgaagtcagaagctatgaaaaaagtaactagctatctagatagtacctgaatattcaaagatattcttcataagaaaaagaaaagaaaatatgtacaaaatgacgtacattcctagcctcagctaaactttgccaatccttgacctgaatgattctacttaaactttgaataatgaatatgatttctaaaaacaatatgtaagcagacctgggcatgatagctgatgcaaatgctaataaagctataacacaaagccacttttaccaaatggagctccggggcaatgacatttaattttttgatctagtgctgttgaatgtctcaaagttgctgctaagcctaatatatctaatacataaaaagatattcattgaacacataattataaaaactcagaaatctgtaaagaaattaaaacaataaagctaattaatttttttttttgaatttataaggggatttattctagcaaagcatgaatgttagcaagtgctataaatataataatatcaattaatcagctaaaataatatgatcagtaacttaaataaatgaatccattaggcaacagtaccaaataagaaataattatgaaacagttcgaatcaagcatttagtcaaggatcattgaaaggaaagatttacatttatacaaggattgttctagtatagcttaacaagttaccaagtatggtgccaatttttacctatgagccatgcaataatattaatctaacatgattagtaagttaaataagtcagtaggccggaataattgatgaagagttgggactaaacaatttgtcaatggtcacaggaacatttggtttaagttgtcactaagctaatgttgttaggttaccaacaggaaaaacaaatgggtttgtaacatgcaagctggacccacctgatacgccaggctgctgttcctaaaacctgacttcctcaaagtgacatcttgattagcttgagctgctgaggcctaagcaaattgcttgagtgcctgctaagtggtcaagccactgtcaggggctgtttgggccctacatgggatgcttagggtacacctaagcctaggaggctcggataagtgcctgtaaaaataccacttattgtgatacttcctgattgtacttggaattaagcactatttttcttagtgcttatgcttttctatgaaaactcaatggaatgctgacataagactttaataccttcttagtattgctctattttcatagctttatttctacaccggacaactttgcttctttgagctttattaaatatcagcagtctttggatcttcgatgcctaaaagatttgtcatcttgttccctctttgttaaaatgaatggtggttaaagcgcttgttgttggacatgaaattagttttcataaatcagtctgcttgctttcttttgataaaattggcctttatgcttcccttgtgaaggttattcatattaagctttctaggtggcgtgagtatttctgtttgatattggtgtccactcaatgtcttttgtgggaaagcctgcatgctagaactttcagattggtcatgctacttagtcccaagttgttatcagaaatgattaagttagaaaaaatggattctgatctttcatacttaaactatagtaggcatttattcctcataaataatgaaatttgcattttgcttggttctttgaccatatttagttgttcatgtttgtcttattatttgcttagattctacaagtacattgcataggaaaactaaaagttgttggggcttcattagctagaactgtagaaagaagttatgcattatgatttttggactgtttgctaactggatcacaagataaaaatttcctaaaggctacagatctgagccagatctgagtagactaacaaatatgaaaattttggaatacagagcaagatactaagaaaaaaaaaacaggtgaaaaggagaatagagtagcagaagagaggagaagaggaagagggttgcactgctagaataccaggccatgcaccctatcatttgccaatattagggcagtggtagtctagggtatttcataagggggtaaattagtagttgatgagtccattagtttttgtgaaatttagttttaacttatgcatttattatattgtttaaaacaaaagaatcattaaatttatgaaaacttgaagtggattgaactatagtactatgctggtccatatcatattggtattcctcttggtaacatgacatatgtttacatggtattgcatctcacttttcccatgccaacaccaacagacatatcatttgttggtaaaccatatggtaaggtacctatacggatacttgtacttggagtttaaaccatgcatatgatgctcacaatgctgtaacatagttcatgaatgagattatatgagcaaaaaataagagggtgcaccttgtgcaggagaagtacttttctgttaataatcaattcccatgtcccataaaggaagcaggatcaaaaacaaatctagaggaatgataatcaaatttgggcaattggcatgaataatgaaaacacattagcgagaaatgagatgttgcccctaacaggaaacaagactagttttcataagttcatttccaacatatgtaggatcacatgtaaatttttgttttcattgctttctcattttttttttattctcacttttttctcagcctcctcccttgtacccaactcctcccccacttatgcgtcctttacttatatgatataggccaaagagtctagatcatggactatcataccaccttgaactgcctggttcaaagtgttctgtatcattcctggttggaaatggtataaaaattgtattagggtcactataggcctcatactgacccgtatcaaacttgccgaggcataccaaggtgaattggggtgtgcattgatccatactgagacatgctgagataaagcaagaaaaatggcttgagagctgtcttagtatggggtgtgtactgtctcacattgatctgtaccatactgaattggtaacgtatgggtatgatacttgataccaagattgtggaccttggcctcgatattattaaattattgaaatcttggtgatggaggtccttatctgctataaggtctttccaaatagttttaaccttattgctgagtcaggtataataacaactgcagtgggtcccacttaattccatttgttatctcctaaaattctggtaccatgaaaatgggaagcggagttaaaagatacttacgggaatcaatatttgtttgtaattgattacattgatagaggtaaatccagatggaccctactctattattacgagatttttctgaaatttctcttgaactattggggcaagtaacctcctttcccttgcattactattggatgagggatactggtaatgtgtatatacgacataagtacacctatttaagatgcttgctaactttatgtctactaccactactataaggcctggtcagggccattcaatggatcccttacatggcctaggcaattaggcagccatctaggaaggaaaagtttgaaaggctgtaaaagatacatgtgatgtttatatatggtacatcctcttaaataaaacccttgctcatcatacatggcacaacaaatgttttctgtattcaatgaatggaagaactaaaggataagagaagcaatagcaatagcttgctggctactgtagcaatagtaagcagtagatggtagtagttgcagggccagcactcagctattgaggtggaaatgtagtagctagacaagaaaggagggacagagaaacaaggcaccaggaagatttagggagaggagggaggagtaggagaaggcagaaatggaagaggaagaggaggaggaagaagaagaagaatcagccaactaatgcaacattttctattacgtgtatgttaaattagctcatagatcgagtgcaggaatgtttctaccatagaaatcacaagtattctacaattaatctcctctccgacaaccacttggttggtggctggggcagggaaacaaatagacaaacaacctaacaaggcaaagcttgcaagatggaggagccagtcgggaattggaaaaggttgggaataccaagcagcttaggcctaggcgacccagccaactaatgtaccaaggtatctgcctgtgcctctaggtgaacacctttaacaacattttgtataacatgtatgttaaattagctcacagactgagtgcaagacattcctgccataaatcaaaagtattctaccattaatccttcaactcaattgtacgcaaggtttgaagtactaaagtatggggagtcctgttcaggtttcggcacagtgcataacgtaatacactcccttgtcgactcataatctgtcaatatggcacggacagcacatggtacttgctgcgggacataccttagtatgcctcatgaagtatcatggtacaatcagttttttgaaccttgattggaccaacgagaaaaaccaacaaaacatttttttaacatttttgtcatcattttgaaatttaatgaggattttatgcatggggcaaatatcaatttctttttttgggaaaaggagggagtgctgaaatccaccgactgggagaaagagcttacaaagagaaggttcccgactaagcactcgagttggcccttagtctgtcacttatagtggtaaactttgggcgaaccaaaagcaacatgaataaagaagggacccaattggaacagtgagtaatggtaatcttaatgacgtaaagaggaggcttgtgatttttaaggaaggatttaatgttcctctcatttcaaatgcttcaagtgattgtgatgaatagttgaccccatgcatttttaggatcttgtggaatattcataatttctcactctgtaagcgaatactaaggatagatacagagaaaatgtggctctagacggtattagtgaacaagccctctgaaagaaggtgatccgcagtctttgtggtggagtcccacatcaaaaatctaaaacaaacatgttccctaactcttcctgcaatgaagtatttccttagtagcaagccgtataaaaattctgaccataataaggacaataactttccatgtggggaaaaagtttagttgaggactcttctgtggttgaggaactgttaaaaatgattacattgagaatatccctgaagaatcatatatccaacaatataggttcctttcggatgctagtagagcaccttagagaaactaaaaaatttggacttccaccagtagataatttttcaaggggagatctagggagtggttttgactaatatttgaagcaaatcattatgatgctattgtcgcattgtcattctagtatcctttgttgaggcttcggaaagtgctgctgctcaactaaccatctaccttttgaaaaccaaacaaaccttattgcctatggcaagagagagcgtggtctagagatttaaattcgttccaagcttgcaatgctttaaagatcttaacaattcttgtagagtttgtgtttactataattagaggcaagagtaaatttatgctaaagtgcaagcaattttttttgggatttccatgtcaacaaagtcatcaaataccgagtctatgaagcacaaaaatgcatatgtcaacacggcaaaccttgaaaattaggagttggggaaggtctggttggtgcagtcactatgcttagaactctcaatatcttggttaagggggatacaaagatggtgatcacttggattttttgaggcacccattttgttagatggacaccttatgtcgggagacttgaggaagctgatatcgaccttgtttaaggtagctcatgtctatagggaggctaacaatgcaacagactaggtgacctcatatgtcgcaaattatactagcatagtgatatgggaatcactcttaacggcacccctgcttgtacgtgattttgtattctaatgctagtggctatacttttgttagggtagtgtaattgtgccgcatcaccaaaaaaaggtaggatattgtattaattaggataccaaatatatacatattttatacttacatatacgcacatattcatacgtaaatatgatacatatatgtgcatatattcatgtatgtatttatgtatgtatacaaatgttcatatgaccatagtaggctatcaaagtaacattgtctgtagactccgtactttatatgaaagtatcaacttccagaatctcatcatttagtcattatttaatttcatagacctaatctccatatttcatattgttatgttaatgccatgactttgaaatttaccattcattattatagggttaacattttcttccaaaaaaaaggaaaatgccaccttcatatttgaatgtatttgagaagcatctcaagagtattttggatatattgagagcaaggattgctgaatcagaatcgaatgtcgtgctggctggttggtagtacggtttggtacggtttcgtatcggtccgtgctgggctgaactgacagggcagagaaggggagagcgagaaaaaagagtggaagagagagagagagggagggggagaaggagagggaagaaaaagagggcctctacaggccgtcggaggtcgtccgagctcttgctgagctcgataaggcagagggagggaaggatcaaaggagagagggggagatcctccttaccgggtgtctggaggttgttggaggtctttggacagacggcaccgccgccacaatgtctctgatggctggcgagcaagcgacgaagggcggctgaggtcgaaggagctggggagggccttcgtggtggaataggagttcacccctgttctatgttttttttttcgagttttattgcatgaaattggcaacacagccatattttatcattttttggttgcagacttcaactgaattttttttaaaaaaaagataaagtacggtgaagttggcaactgaattatctatttcgcatgatgaaatccaaaaaaatacggaacaggggcgaatccctattttgtagcggaggcccttctcggctcctttggcctcgatcacccttgctgctcgctcactggtcgtcggagacatcatggcggcattgtcatccattcggagacttttgacagtcttcggatatccgatctctctatcacttcctctcttttttctctcttctttcgagatggttgtcgtgccattttctatgtcggaattggatcggtttcccaccggtatggctcggcatggccaaaactgtctagtttgggatggttcgaaaaatgttgattgagagtgctttttttgtttttatctttttttttgatagaccagacgaatcacacaagtccagtatgaatacatctaacaaaatcagaatataaaatgatgcggaaggggagtgatatggtcaaataatcaacccataacatattttcagagtactcagcaacaaaagaggcaatccagtccgcagctttctttgcctcttggtagacatgactagcctagaagacgttacagtccctcgcaaaatgccaaatgtcctataggaagggatgcccaaccgctgcgttaaattgcctctggatctgaccaaccattgtagctgagtccctctttaggtggatacacttagcccgcaaccaaagtctagcatagctaagtccagcccaagcagccctcaacttagctccagggattgtagtgtcatgtatttgactaccactagtagcaatgaatcgagagtcggggcctctgatcacaaaaccattgtctccgctgtagccactatcagacacactatgatcaaagttcaccttaaggaagcacgggggtgggggctcctaggtgataaatatcatcgggttgctgtaagagctgaaaatgatacaaatatagaagatgcatttgagaagtgtccgacacatataggagacatatcgagttttggtatgctcggtatgaggtcagtttagcgtatcgttactagtatgatattgctatgctcgatacattgcagtatagacaagtatgtgtcttatgtatccaaaatggaggcaacatctgatttgaagtatcttgcttcttaactgattgttagttcaagtccagggaatgctttaaggtagcttgaacataaacatgattttaaaagggaaagaaaaaaattgtatatagtaaggtccatctctctccctcaagggttagcatgttatgtttttgactttccggtctcttgtctgcctactcaaaaaagcattaccaatcatgttgggaatctactcaatgaaagaagatcctatagtaagttagaggaagtgcatttgtcatggacaaaacaagaaacaggaaccccctctagaggcatcatcccttatggtttgaggtaccccggaacggacgcataccagtcacatactgacatgatgtgtaatatcaactcaggtgtgtcaatatgcctccatacagaatgctgtacataacttggtatgccttgataaggggtgtgttatatcatggaacagttgattcagccatatatttaacaaagtctttcttaaggtttgataggagctcaaagtacttaaggattttgtctgtctaggcatgaaagagaaattgtcgtttgaccatttgaagtttaaatgccaccaaaggaagcacaactattaggcccaatattggttgacttaagcagcaatattcaagctatagaaatttcatcactagattttggtaatatggggaataagttgctacatgtgttgcacctatcaattggctttacagaattatatctttgtaactatattcacatgtcattttatgttggcaaggacctacttcatagtctattccgagcttgcagattttgtcaaattatgttattatgggtctaaaactttgtattgaggccttttaacaagtttggaatgtagaatcgtctttctttctttctttttcttaggtttgtttgatatgattgagatttgatttatttaggtcagcaatccgagctgcttttaggataagtttgttgaaccctatgaacaagcatgtgaatttgttagaaaactccaaattttgaattgcgataatgttttcttcttgttagctaaatttgtttctatggatttaatgcttgcttgctgctgagttagatgacgtttcttatttatattatattgctttctcaacttttaactacaagtaaaatggcacactgtttatgtcctattactcttgcaagttgctgtgttggcaatgggttgggttgggtcaagaaacccactacttggacctgggtaatttggcaaatgtgaagctggcccatctattgcatattaacccaaacccagcttgcagatccacttacaaaaggaggggaacaggggagggcgaggaatttgtgtagtttgctattcttggggaagttgcagctaccacttaacaatttgtaaaaaggtcagcagaggcagttacaatgggttggtggagcctttggtgcaaggggtttagtggtaggttagggtttcagcgggagagataggagttatttttaggggttataaagaaaatgtagcattgttttaacactagattattagttttaagtcttcattctgttatattcttcttcttcttccaaaacatgctttaatcttttctattattttaaactaaaatatgtaaaatcttgatgaaagacatgttatgaaaagggtgatgaaggaatatgacttgatggtacaaatcaatccttaggtgtaagaaaaaaattgaggtacccagatggagatggggcattgccatgagcaggttcatggttgcaaaagttttccttaataaaattaacattgttgaagagttggttactttggcagagctaatggttttcacaaaattgatgcatcattgaaagcaagccatgatgaacaaggttatctctgatcagtaatccatgggtaacaaaaaatagatattataaagggaaatcaagctgccaggagatatgaaagagtgcccagctatatactaatttaaaatggagaaatacataatatagttgaaggattttttttttttttttaaatcttccttcctttctttctttttgggtatttttgtgtttaaggtttatatgattcaaattagggaagattaaaattattaggactctgaaaaagattccttttagaaacctaaagaatatgggaacctattaagtgggttgttgtgaaaagagacccctctttgaatgtcgtattttttgaggaagcaacaatagcaagagaacatgattagctatcatgaaaaagaagggcattggattaaaataaaaaaaaatcaaggtggggttgttggtggtggtggggggtgggggcggtggcgctggcatggcaggcatgggagggcaagctaaggtttggagggcgcactccatacggaacaagcattacatggagaaggttctgatcctggaggagccatagtctcccttgaaataaacattgctctgcccctggcttggttgggtaaaatagggagaggtggagggacggagaggagaagagggtgggaggattgagcatttgggtttggacaggctaggtgttggttaagagagagttggattaggggtggttttatgagataggtagttcctgtggaaatagggaggagggggtgagacttctgactttagagagagagagagaggtgcgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagactctgacttagtagagagagagagaggtgcttggggaagtaggcgaatacctaggcctaacacctacaggaaggttttggagagaggaaaatgcggaataacagtctctgaaactacatctttttttcctttttcttttttccccatttttaaagaagggacacgtgattggagggacataatgaaactcatgatttttccttgtctttcaccaaagtaactactccacctagacaaatcccgtgcctcttgaactcttaacacttgggattcccctattgacaaaaaagggtatgggaaaaggccctgaaactgatcaggttacttggttagtcgcagacaacccaaagcttggcccacacattgaaatactacacgcagccttgttatttcaaatgattttgagttgaagattgccattccaacaagtggttttgtttcgacttatttcgtgtgagttagtagtactatacactagttatcacaaagatcattgtcgaagtttcatgaactggtattaaggtttgggaagaaagagaatttattagtcatgaggaaagttgctagtaatgcataaaaaccaaaaatcattatatgcttttgtgggattcaattattaaatatctaaaacttgtattacatggcttagtatcatgattattaatggatggttaattttagaaaactatgtgcttcagggaattcaataaaataatgtgttttacattgacccaatgtcatatcatccaaacttcaagaaacttgttaacatagtaattgctccttataaaaggggtagaatttgccacttcaaaacttcaacataataaactggtagtccatagaccttttgcaactattgacaatttgacataaactttgtgatcaggctcaagttattcaaccacaccctcttcaatgacttggttattgtttttgctgaattaggaacttgttttctgttatgtaacctagtgttcaccaattatcctgttcacttttgctttgatgacctaatctactcattcccactgaacctcctcatcaaggatcattttaatctagttttataactgacttaatcatctttcgttcaacatccatattaacgcataatagtcaattacaacttccttttggatgcataccgtaatctctttaaaatgccatggattgtctggttgccttttaatgccaaaatgcacactcgccatgttagatgcttttatggtagcataatatggtaggtctattaatgtttatattatgctttatacattatggggacttcagctgggattacatggttatgatgatctccatttaatgccaaaatgcatactggagcatatcttcctcattggtcttttttgtgatagctttaaatgatacagttattcatacttatatgatgccttatatgtaaagttgcttactacattgttcaattcctttgacagccatgttcaaagttgctgttgttgtaaactgacacgagaaacgccacacagacttaaagaacttatcagcaataatgcataaaaataacaggaagcagagtaaagagtacagaagttaatttgttcaccttgatggttttttcagcgttcaaagaagataattccctttgtttggttaacaagacgataacccctttaaagagccccctttagatattccttataacattttactataacttgatattctacacatttttaacaatatcagatcaagttattaatgtccatcctaaaatggtatctgatgagtttattcatgtctggtagcaggcttagtgaaaccaatgagtatccaattactgtggggcaatcaacagttggcattaagccattcctcatgttgattcaatacattcacgggtactgggttcagttaccagtacacaatttctccatatgtcaaccaattttgtgtaaagttggcattacaaatagatctgctcgatccttctgccgaaccttcttgaatttttgagtcattctccacagaactccaatttgacaataaaggcatagttatttggtcgaatgattgatatctgttagttacatgaagtatgcatattttggagcttttggtttcggcgatagtgattatgaaaatatgcatgtattaatatgcatagtatgtgtatcttctctaagataataattgcatatgccaaaactttagtagtacaaaaggtttatgcataatatgcatcacatattgctaaatcagctttctttttgtatcagatttggattaattgatatcaattctttattgatttatttggaccttctgttttactgaaccttcaacttgataaatgtctggtctaccaaaaattatcgttcatcaatatgatgcatttgtaaaacttagaaaagcattttttttcttgggcaacaatctttatattcccctcaaaaaggttggtgttctttatatctcagaatcatgctgattttcttttttccaggaattgtcttaaatcttaccatcctcaatgtgtggggaaggatccttccttcttggagacagatgaacgttggacttgtggttagtaatttcctgtagttcttcacatctttgtttatcaattagttttctaaacttatctggatttgagacatgatattttaatcttttctttgacatcacttttataggatagtttggtgcattatgaatgttgtccaatctattataaattcattgtgtgggaaacagtgccaatggattcaatcaccaaaatctgagtaagaattttttgatttaagcagtatgggaaccagaataattgatttgctgcttatcaagctctgtcaatcacatatttgttattgtaggtttaagaaaattgatctggtggtttttacatacagaaataatgtccaatgcaaaaattgtatgtagctgtcagaccatgtgaaagtattaaatgactatcatctcttttatgtgataggatggcatttgtgcttcatatgccaaaagagctcaagtttccaatgtttttgttgtccaagctcagtatgccgcaattgtatcagagaagctgagtttgtgcaggtgaaaaagaagatgaagggcttctgcaataattgcttaaagctggcaattctgatagaggaaaatattgatgttgactctgatggggtaacactactaaataagcctcggcaaattcttaattgtctactataattctattgttttgatctttgttatttttgccttaaccttgtcaaatttttcacttgttttctattcatatatgcttggcttctattagcttagaaaatcccatgaagatatttggcaaaaagagaaaaaaaaagaagaaaatgataaacatgacgtgatgtattttcaagtttgaacataatgcaaaaagaaagcaccgatagaaactaaatatcataataataattgatcgattattcatgagacattctgcaattccaatcaaaaagagatattttctgatcagatttgtcgagaacaacttggtttcatcacacaatgatccagaagagaggaaaggcatggctgtacataaaacctaacattatctgttgccaagtctaactcagtcccatgaacacaataaagtgataaacatttaaaaaaactttggagagaggattttatcttcatcaatgaagtccttccagggaacttttaatgagagttgaggctttttgttgttgttattgttgttgttattggaaacatgaagggagacatagatatttcagtattagaggtgtaatcaaatagacgtgctgcagacttgaaaagaaaattggaaaaaagaaagagatgatatacagaacatagtcacaacaactgctttctcattttcatttcttctagtcttcttctttgactcctgcatgggtagaatctagaaaagatacataaaatattgaaccaaatttgcggaggctttacatgggactagcctgtttagtattttgcaaaagcgacatcaagctcatgctattgaggaaagagaaatcttataaattctacactagtgaattgtttgtgattttgtaataaaaattatattggcaagtatggtttgccgaactgccccaaatggtactggtggccaactggcgatggttctggtgtttgaaacaagaaactggtgatgagggggagagggagaaagaaagagagagagagagggcctccggaggctgccggagggcagccaagctcactgtgctgctcccaaaatggcccacagctgctcgaaatggtccttaattgcactttaccaagcttatatatattttacacctgttctttttttctgtatggtatggtttgatactgttagtatggggatgcattgtaattttgaaatgttgcttctagatcagatatctggttgagttgtgcactatgatacaaaattatacagatttttgaccatacatggatttgtaccatgactttaaggccaagaagcagcaaatattttccaatatggttagtttagtacttcaatgcttgtaggagttggacattatcaattattttttaactgttttctgtaatacgagtattttgttctacatatcatgatgcaaaaccgagttaattagacttttgaatatggtaatagatgtcagaaaccaaggtttcaagtacgggtatcgaatctcgtattatttttctattacaattgtgcaatgtcagcacagcatgggttccgagttccgacgttatgtgccaaaaccgagcgcatcaaaaaaagtgaaaaattgtctgcatggatcagtatggttggcaaggtaccatcaatggaaagtggtacaaatcggtgtgggcagtacatactaatacgctgggttttggcatccagtcttcatattggtgctggcatcctgttttggcagtttttgaatccatgcaactgtttttttttttttttgcatctaaagggtcataaacacttatttagattttacacaaagttttcatcttggccgagatcttggtttgtattggtggtatcgaacacctgtcgatgttatatatgtaaaaatcaaggccctattatgtcggttgatataaactgataaaactcgagatatcggataatatgatataaatcatatcggtctgaaaatatcacccgagatattagaaaatctcaacgtccatcagttcttccaacttaccatattgacctagctaaatagagattttggttgatctcagtcttagtcgcttatctaggtaactgatatatgaagatttaaaaaccttgattttacacaagtgaaagttcctaggttgtttaaggtgcttagatggggtgaggcacatctgattcatctgaagccccgataacccctggtgaggcagggttgataaggcaatgtttaggcgtatgcataggccaagttgagaggtgttagggaaatcacttttctaatcttgattctcaagctccattcttcaaaattccttatttctcaacatgtctaatatctaatttttattggaggggcatttttgcccaatgcaacgcttaaaagcgaagggctaaaagaaaaaggaacccacctcctctttattcagctgggagctagggttttcaagcaagagggcaacggtggagcatgaggtaaagaagagggatagcaatatctaaacccttacagtttgcccttctttattactccacattgtccctgtttctcccatttaattggcaccaatctccattttattcttcccatgttattttatgtgctctctgtgtgtttgcatgtgtatgtgttagtttcatcaaatcaggaagcataagggggtttccttttctgttgtttctattttttctttgctcgatctgtctatttaattgctgtttcatttctcttcaattttctgcttcttaatttctttttatttttgaatgcagtgcacatgtttgatgtgccagaagctatcccccatgaaatgcatgtcaggcatcttgcactttaacctaattttgttacagcaccaatatgttatcaaatttaacatgatcatgaacagcattagaagtttgggttcaaatttagtgccgagaatctgggaatcaacatgggctgctaaggcgtttgttttttcttccttaattatttagtgaaccgaagtagtttatgttaggtagttatcataatagatatactgtttttgtttgcttggttcggttatagaagcaatctgatgtcttcaatacaagaaacttgtcaaatttcattatgatctaaaaatttttcatattgtttatgtatgattcatgaagtctactaactccatatgatagagaaaagaaatggtcagtttgatgtttatatgatacagattgtttcaaatagacaggtttttgaaattatgagcatcttccatggttcattttttctcaatccaatttcactgaaataattcttgtttgcagggcaaggtagatttcaaagatacagaaacatatgaatttttgttcaaggactattgggaaatcgtgaaggaccaggaaggattaacgttggttgatcttcatgctgctaatgctcttcttaaacgaggtcacaattgtaaaagtgaatcagattctgataagtttcctgaggaggagttgatgtctgaatgtgatgacttggatgatgattgtcataatgagatgtcaatcctcgatgatttaaaagtaaggcgtggtaaaatgaaaactccaataaaaaggtgtaggtcaaagagaaagtatattggttggggctcagaggagctcataggattcctttcatccattggcaaggatacagaggaacctcttacacaattggatgcttctgaaattgttaaggattatgtccaagcaaacaatcttttcaatcctgacaagaagaaaaataaggttgtagtgtgtgatgagaagctgtattctcttttcaggaaaaagaaagtgaaggttcataaaatctacagcttactggaaagtcatcttgctgcagatgatgatatggatgacgaatttttttttagctcggatgatgatgacaactcagttatcaggagaaagtggcaaaggacaaattctgattccaagattcgcaaatcagagccaaatcatttcaggcaaaaggttatggaacctcccaaaagctgctatgcttctgtagttgacaaaaatattaaatcagtctatctgaggaggtctttaatcctgaatcttctgaaagaccctgagatttttgaaaacaaagtcactggttgctttgtgagggttaaaaatgatcccaaagatttctactgtcgacctcaaaatctataccagcttgggcaagtgacaggtatctgcattcatgtgcatgcatttatgcttgatgctgtccctcttaagcatgtgctcctcctaggggaagcctaaacctcaaaatgggtacgtgccatatgttggcaccttctattatctgctagagagaaatatacaaacccctttgactttgcagtcaggggtaagagaaatattcaagtccaggtgaatatatgtctgccatgcacccatcttgagattagttttccttttcacagaatggagagccaagtgtacacaacacacatacatgtgtacatacatacattacattacattacatacatacagacatacatacatatatagatgtatatgtatgtgtatgtatgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacacacacacacacacatatatagatatatatatatgtatgtgtatgtatgtatgtatgcacacacacacacacatatatatacatacttatatatataggttgaagaagagataatttctgttttcgtaccaggtattaagaaggttccacatgcatacaaggtaggagagacattgacagataccgtcctatgtgtttccaatatgtgtagggatatccaaataactatgttatcagatgatgattttgaggaggtatacccagtaagacttttgttacacacttgttaagcattgcatcatttcatacaatatcttatttcttaaaactcatcgtcaatgagtttaagtcaaaatatgcaattctctctgttctgaaacatatactgtagggttattagacaactctaatcttctcttttgccaggtgttgctttgatgatatttctaattttttaattcacatgcatataactcagcaccagtcttttgagattttatgcaagcacctcgcttaattcctattctgcatctctatgataggaagaatgtgaagatctctgtgagttggtgaagagaggactccttaaaaggcctacaattgtgagtttttccttcttagagctatttaatcttgtgataccgtatgcctaagcattgcttttgcatctctgtacctaataaacatggagaatcagtatttttcaacctacaacatgaaagagactcgtatactaaatactatcaatctatcatggttatcaacatacacttttatgtttttcttattttatttgataagttgtagtctaccagaatttattgacaatagaatatttattcttatttcctttcttctgcaatagtttttgtatgaaatgaagaaagtaataagtttctaggatggtcattttgtttcagtagctccatgaacagaagaaaagtgctctttcatttataagtttaggagacttccatccaggtggttgacttggctaacggagtcttttaaagtttaaacacagtttatatactagagcagtgtatattaagtatgttattattatctagaattgcagataacagtagttcaagagcaaaaaatggttgaaatgtggtgcaaattgctatggagggtaggcaacattattcaaatcaaggattgtgaaatcaactttcattggaagagaagggtaaacaagggtttggtctttgtttggtccagtgttatccagaagccattgttttaattattttcttttacaagaattgggctatggatgtagatatgtatagtagaatctctgtaatttggatgaggtggagatgctctcattctggatcatcaaaatcttggggctagtgacttgctaacaatgttgtatgtgttggcatgttgggtaaaatgaagcatgtttgcataaattggtaagaatagtaatgattatgttgaacttagtttgtggaagcatttggaacatgctttaaacataagtgtggaaagttgacttcaatgctttgttcactgtaatgaagcctgagaagagaaaatagaaggggcttatgggatttggctgggattcctaaattgaagtgatgagaccaaggaaaacatgtattgcagtggccgagggaaatgtaaatgctcgtggccttctatagcagccaataaggaagcaaaattcataaacaatgcaaactgaaagactttccttattatgactttctatttgaatataaccatttatacctttgcaactgtatgctgattaattttagttagggatatatttatcttaaatagagttttaatctgtttaagagtactatttttgagtctaacgaactaatttacggaaaagtgataagcatggtgaggttaatagtcttttagtcatttggactgttttgaagagtagctttaatttgtttatattaagatttatttcaaatttctaaagtccacaatgcttgttgttaagattcaactatcaaaatttaaatgctgccaacctttttaactttatattttatagtttgaatattggtcatatatcaagtactgatgtgtgaccttcttcttctctcgcttatgtctaacgtcccatatgttaaaggggttcggtatctctcacttttatcatactaccaccttttgcttctttaagacgtgaagatattaattcattaatatcatgctaaagttccttaaaggcctttctttttttttttttttttgggtaccttcatcgaggcttttattaggttctaaacattgcccatttttctttcacatgcaagtacaaattcctaaatattagtattttgtacttttattttgtttaaaggtgaaccttggcacaacagtaggttgcaccattgtgacctagagtttatgggtttgaaacatggcaaaagcctttctgcatgaggggttagggctgcatatatctgaccctcagaccctgcaatggcaggattctcgtgcattaaggcacccatttactttaattttgtttcatcttcatatgttctaactttagttcatttgactaacactttctgtttacaatatcattattttccactagagcataggggttttcagtatattcattaagatggctacttttaaattctgctcgctttttattaaagaatggtctaccgcaccattacattttgtagaaaaaaagatgttgttttagatgtgctaactttttggtagccatttggaaatgcagaaggatcagttctggtccatagaaagaaaggaaagaggattgattgcgattcttgatggaaaatgtcaaaaatgggatgtgatttttttctaatttaatgattaagacaatcaaaaaaaataaaaaaagaagaagaaaaaggagagtggaaccagatgcatccttgcatcaacaatatcaaatgtacatataccacaaaagagggatgaataatttgtccattagttgtattcttcaatcaccagtgtaaatatatgtgaatgtcaattttcttgcttcagatggcgaagtacatttacatttattgcacagtcatctaagaaaaggatcttgtttcacatgtcctttgcagtgattatttagtcacagaactttggtcatatatgttttcttcagtgtaatattatgtctggaaaaacaaactcaagataatcttatttgaaaactccattagttatatttacaaccttggtttctctttttctgctgaattgcatatttatctgtctttttatttttttctgagaaggcaaacttatcaaatttctttttagtgattacattgatgtctaaccaattttgatttttcttgctcttttggcaggcagaacttgagaaaaagatcagaattgtgcatgaggatattacaaatcatgtacataccttttgtttctttgatatgttagcaacattgtttcctgaatctgccttccattttggaatttgtgtcttcagaaattttatttgcgatgatcttcttttgttgctgtttttatactctgttctttcaaaagtaatcttgaagattgcaataattgcagcatgacatagtctcgtgacttcctaaaaattacatgtccctgtgtttgttttttgtaagaatgatagattgatgtgaacataagccaggaagctagttcccttgtttaatttgctgattattctatatgctaagtttctcttttactaatctagttgatttcttctcagtggattgatagagagattgtgaaattacaaaaactgattgatcaggcgaatgacaagggatggcgcagagaatatcctacaaaataagagctgaaaatacaaatgcttgtggacatgctataaaattcaacaagtccattcatctgctgatctagcacattatcatcttgtacatttcactggcttagttgatacgcttgaaattattttttcttgactctttggtacgctatttgactatattgaccgaagagagctgctctgtacgccagctgaaagatcacgccttctaaaggagattccacaggtcattgcagatacagaagaacaggttgaagtgaccactgatacattagtaaagtctcatggagaacataaaggttcactgtactctttgatttctgtttagcatttgttttggatatgttcttttttcggtcttgagagttttctgtttgtgttctgatcggttttttgctatattctagggaaaatttctttgagcctctgacagtgtggcccgtaaaaccacatctctttttctgctgtatgtgaattccaagtttaaggcactcttctttttataactataaccactcaaaataaaaaggaaaaaatagggtctcataaatgactaccaaagagtatataagtggtggttctaatgctgccagtttggtatgctggtaccatactattctgatgagaaaacagggcctgtgtaggtgcaggacactggttctcacctgattacctgaacgagtatgtactgactatactagtatgtacccaccatattggtctgtactgatacccaggatgtgttgggagttggtatgcattgattcctttttattcttgttgattctaattgtttcagtccataatgatcataccagtaccttaccattttggttaaaaccaacacgggcctggtactggtatttttaatcttaaaataaactaaattggtaatatagttgtttaaagtatggcacacaatcttgattgatcagattgtggcatatgctcatagtttgtcaataaaccatgttttgcatatgctcattgtttgtcaataaaccatgttttgcatatgcagggatctcttcatattgactctagtatggcatgagtaatgcatgtggccttagaaacatggaaacatgggttcatggagattcatgaatgaactcccatctgtagtctggttatagagtttaccatgtaatatatgagcagcttgcccctattaaagcaactgcacagcaagtttattggtgttacaagtcttgagggttaacaaggttgttttgagtagcaagttgatccgattgttgtcctactatattatgataggctttaaaccaaaccgtgaccctgcagaaggccgaatttggagtcttgaagggagtcatatcagtcaaaaactagtcatgatactttgaaattgagacttgaaggattcaaggttttcggcactttatagttttattgatggttaccctgaaaatttgaagcattgctggaaagagaagatgatacgacgccaaggtgtgagatgcgaaacatttcgtttaagatgctgaaaatatagggagaaatcccatttgtccagcttgctttcttaaacatcagtctttctctttctctgtccttgagcttcaatcatttatcatttgataacttctaattattttcttaagacatgcatttctttttcttatattaatgagaatcttatggaattcgaagttttggatgcacgtgttgatgtctgcatgtgtggttcctgtgatactctcatatcaactgttattatggttttgtcttaagtagctgttagtatgattggcaggtggaaatgtcgctattatggaagtcccgccagaggaagctaaaggtttgttctccttgtcttgtttctttcttggtccattacagtttatctaaatctttagtttattgaattaaacatgggatggagtagattggagactttgatgtccagattttatataaaaagctcaaatctagattaaaatcccatggaaattgcattgcttgggtatctaaacatgataaaatggctgtcaggattggcgaagcaactagcctgtggaacttagaaagaaattcaatcaatcttgatggaactgatttcatcaaagatgcatatgggattgtctgaagaaacttattttattccataatgaataaattgccttttgacttctaggtgttgcatttcgatctaacagaaacatgttttgcaatttttgttcttcacatcttgattgcaatacatgctgcctctcagaagaaaaaaaagcatgaagaagaaatgaggaaccctttgattgcttaaaggcacaacattatagacagaagaatgcagtatgagagagaggaaaaaatattgaactggtcaattcttatgcggtgaaaaacattcaatcgtataagttagaattttaattttaagccatgtccaaaatcttaaaaaaaaattatccattttgttacattacatcgcatagcacccttaaaatcagggttcattgaactgtaccggcggctaatcagtgtggttcggatgtttgattcaaaatgttggcaaaaacggagtgggggagaaggaaagagaggaagagagagagagaggaggagagggaaggaaagggaaaggccggtggtggtccgccgacgctgctggggctccaaggtcctctatgagatgcgaaaagagagagaaatgagagggagaggggaagggagagaagaggagagatgggaaggtggcggggaggccgtcggacagtccaaaacaaccccgcggctgtcgcgggctgtttgtcgtttagtggccacagcatccctccagcggcctcttggttgccttcccctctctcatcttctctccctttccctctctctctttatatctctctgctttcattttctctcatggaggactgcggagctcgagaggactcggtggtcttccgttggcctctgcagccctccggtggccaccgccgatgcctctaccggtctcccttttctttcctccctctccctccctctgcctttctctctttttctctcttttctttcctagttcatccctcgtttcaatgttggttcgggcccggtatggtccagtatgggggcataccgactcgtacagccagccagccggtatgaggtccggttctgagtcggcaatccttgcttaaaacttttggagtcttggtaatgattttccaaaaagaaaaaaatgcatgtgttttaaactgttgtattagcatagcagggaatgtattattctcatgtgaaaatgctgctgaagaaagatctgaagtatgcctatatgtgtactttaatttgctttgaattatttgtaagtgacaaatgctagctatgcaagatgtaattattattttccatagtttgtttcaagctgctgctcttgttttcctttgtaagctttctccgatcttaacagtttggattttttctttctatattttaataagctcaccctaaattacattagggtgcttagtcaccagattgtctggtggtgaatgtctgttttaaggttcggaatctcagtatcggaccccgtagtagtgccacattggtatagtgttggtatgccaatatagggttggttcagcatatggatgctcgatatgttgcacgtactgagtatcagtttggcattggtatggcacagtatgcctgtatggggtggtaggtgccggtactgcgaactttgtttcttagctcataaatcaccttttgtacagtcttcttagatagtccacgtatactttgcacttgtaaacattttgagattttctgcatcatcttgagaatgacacttaactattcgctgaccattcttggttttaaactgctaccgatgagtaatcctgaaatatagatgttcttgttggtgggattggaaaaagataaaatagtgaaggtcccggacgttcctcttcctttcttgttttccctttatttcctctggtgataacttggctgcagattttcttgactactgatataggagagttttttttttttcattctttttctcgactttttcctgaacatgtcatctgcaagtcctctctatctagcttcatccatcatctagtcaattattgattcatcattcaattttcaacttgcttttatgttcccatatattcttttctttgtttccttctttagccctgatcatttattatttaagggtttctgcattcaaacacatttctttttacacccctaaactaagaaagctttttgtggtccaaattttgattatattttcttctggcatttttttttgttctataatattttgtttttattttttatttttttgaaaagataacttggtttatcaaatagacataatcagtggattttggttacaattagaaggtctgcatgtggctactgtagaattcccagcacagggagctaaacatctggaaacttctcagagaaacttgagagtcttccttgatacctttggagatgaggggaaagttctttttcctgtccttttcttagttccaagatagttgaaactattgcttttgaatcaggagaatactttgttcacttcctgtctgaacacatccttcattttttttatttctttaggtttacctgtctttcactcatccattgcccatatttcaacttattaagtagtagtcctttcatttctttctctatttttatctttgtggatctgttaagcatttctgattgctttctttcctctgtttcctcaaaaaatatttcttaataatagtataaattttacatatagttatttagtgttgttgttattatatttcttttttttgggtaatattgtagttattgatctatgatataagtagcttgtttatcaaattttcatattcaattgattttggcttgaaaacttttattaccagttatgttactcgtgaggaattgccattaggataaacaaaaggttcatgaaaataaacttgtttctttaatttttaagatgttatcatgtacattatggttctgttatatgaactaaaaattggttgtacttggctttgcaaatgcaaggttaaaatgtaaataaaacttcaatctaggtgtatataccatggttctatttttgcaactgcatggcttgggcatcaactctgaggatcatatgcctgctagagttgaagcagtcaggcttgccaccttagatggccatctggacttattaggacattttttatcaaagaatgcatatgccatggtctgcatatcttgcgtaaaatcttatttgcttatctctatctcctagatgttaagtttccatccaatgctattgtctaactctgctttggtttttttatcttgatccattgattgcaatatatgctgcttatagaagataaatgtcatcatcatccaaaataaataaataaataaataaagagagaagttgcagatatttaaacttctgctctggtgtagcagggaatggagctgattcgcatcagaatgctttggaccgacaacctgaaggtttgcttgtttatatatttttaaataacttcaattcgaaacatttgtaactagcataatgatcttggatatgtttaactgtaaaacccttctagaagcagaacctatttttttaagtacttgttgtcgtcgtcattgctgctactttgtaagctgttttgggctttcagttcacattttgcttctgatttagcttcattaaacttttttttatgtcttttggatcatacttacattcacttttgcctattcacccgattgtgtggtagccttttgtcttataaatctttcatattcttttgttatctagtgttgttagagaatcattttattaatatcctcataaactttgttttttttttttaattgtatgcttcatcttgattcttgagaatggcatttaactgttgcattgccactttttaaacctttaagacctctggtgacgtttgatcattaaatgtagttgccagtagatgtgattgagaaagataaacttctgaaggttcagacagtacaatgtggcgcataaccttttgattcaagattttaaaactattccttttgatttaggagaagacctcgtcattgctcatctaaacttctctagaagcacgtgaagctttctgtcagcttttaagctaatttcatttgtcatctccatattacttcaatcattttttttttttaattttgctgcttaaacatggcatgccattagaaaagtttccatgcttcctagtcaatatcccattaatctagttaacaattaggaacttagcttgagttttatgcctccaactactgagccatgttgtaggtgtctggattcagtctaagtgtcctttatccatttcttcctgttattccaatgctatagcaagttttccagtttctttcttataattttcatccatgtaaccttgaatcttcttctgctctttttagatccttaaacacagatttgatgacctttccttaggtggcctcggatccttatgcacaggttcaaaccacgttcgattggttcttcattactttagcctcaatttcaccatagtatggtttctcttggtctcatgcagggtttcaggtgctggtccatgttgggccagttttggcacgtggtactgggttgatactagcacagaatgggtgttttggcacagcactgcatgtatgttagcatggcacaaaatgttccttgccggcctttggccagaacgcttcatgccaccaatacttaaatccttcatattatgtttgttgggccctcagtttcagttttttacggttccattacattttatatgtgccgtcctataggctttttacaccttatctgttaagattcttgttcatagttccaatttcacatttaaccttgtcgtcttatcatcaagcaactttacatcacccacaaattagatacaccaaagcacatcttctagataagttcattgtaagagattcaggttagctttggcccttcttgcaaacacaacatcaccaattcacctgctactgagagctacttctctatgtactctatcctgtgctttgttgaagttgatagtaaccattcatggaatccttctctattcccttcatcttttcattctatttcttaaagcaagattagtctttgtgctgcccttcttggtctaaaatgacagttgattctattagattattgccttctaaatattcattctatcacctgttcccactgcttaaatacatgtgtgtaatacttgtccagacatttttcctcttttcagcttgggcattgcctctcaaggtcagacagttataagattggagaagcaatcagactgtttgacctggttaactactttttcttttataggccaatgttaattaaagaacacccttgtattgtatgcagaactcttataatcctaattctttaatagatgaccatatatttgccaactcttaagcttccatctatggtaaccacaccttggattattatgtctcactctctcggttgctatatatgctactataaagaggccaaacagcttgaagaaaacttgtctgaatttgcactggtgtagcagggaatatagctgctttccatgaagatgctgcagaagaaaaatctgaaggtgtgccaatttatttttttatttcatcattgtataaaataattttatgtaattattcctaattaggatggatataatcattgcttgcagtaaccttttattttattgtgttgttcactctgaattaatttttattcatgggcatgatggatcacaagtacattcttatttgcttccagtcgctagatgatcttgtaataatgctggatttcaaaggaagcccttcatgttctttttctatgtactgtacctagagggctaatttattttgttaatttcctcttaacatatttatttcatctagagaatgacatttaacttggtgctgctgcatttatggtttttagtgatggccagtccaagaatgtagttcccaattggtatagtgggaagaatacaaaatgttgaagtttctgaaaataaagttccccttctgcactgataataatgtacaatcttttggttcaagatttttgaaatagttgtttctgaattctgatcaaggagaaaacttcatcactttccctcaacttcctgaaaagaaatcctttacatgctcttgccattctcttaccattaatttttcagcttgcttctgggaaaactaatctttctccctctttgcttttgtccatgtcattcaaattttttgcttttttagagcacccttttttgtttggctttccttgtattgaaatcttcaaattagcatctctttttctggtgacattcttgtgatattttctgatttctattcttgttttactcatcaacttatttatggatttttaatgtggttgattgtaatatgatgggtaggtgcacctgttgctgatgcggaagtcccgacagaggaagttaaaggtttaggttgttaacctatactagatcattctttttagccacttatgatatatttctgtaacatcatgaacctaaagcggttgaaatatcatatagccagaagtggattaaatttctactacatgactatcatatgaatctaatgatgaatcacttaattagtgcatctcgtttcaagaataagtcactatgatgattagatatgaaatatggtgaggaatgtaacaaaatactaatatgttgatatgcaaatcttgaaaaaaaaaggcaacatacaatattgccatatacaagattgccgagtctctcctcaggataagttcgatgtcatatttctcttttcttttcttctctttttaatagaatattttctttgttgcaacaacaataatgaactgcgatccaaagaggctggcggatataaaaaagagaaagtaagattcagccaattaatctattgctaaggggagtaaagatgcagcaggtttgaaaccagctgcttcagccccccgaacttctctggctccgacctcgataagcattcggtcgtttgctgcccctgctgaggagctgacgtcgtagacgtcacatcggcagagcatcgaggtggcctgtccacgcaccaaggaggctagtgcacgcccacgactaagttcttcgcctgtgcctcagacttcgagaagaccagcttgatcgacagaacaacgaccgaagctcccagaggcggctccaccttcaattgaaattgtggatgtggtctagatgtccctctttgagacaccgcatctcggcagagacttgttgattgtggttttgcctcagagggacttggatgctcgaaggagggacttctccatcgagcaattactgaatcatggctacgtcggtctggtggacataagtctttttctatccgtacttttatttgcatcggtttttatcgatttcactgtttttcctttttcagttagccttggaaatcaagttgctccatgagcacttgatatggttccatgaatataagaagtccatggaagaagggctcaaggccgagcaagacagcaagaaagtgactgaggaaaatgtggcgaaagaggccaagaccgctgagggtttgaagaaacaactctaggataagatggcttcaatataggagaaaagtcaggctttgttggatcaatagcgccagatcaacgactatgagaagaaatttgaagatccttgtgctgaagtaaagatggattttcaagctggaatccaagctgaaggaggctgaacagactatagaaaagcgtgataagagccttcttgtatttcaatgatgggttgaaagagagaaaaagctgtgatggcggtcgagaactttaaggcatcggaggcgtttcaggacaaagtcattgaagcctctgaaggtgcctttttctatggcttcaagatttgcaaagacttagttaggaagttcttttctgaccttaatatcagtaagctgacccccgaaatagctttgaatgcatcaactgaggcggcttccgaatctgccactgaggtagctccttcagccacagataaagttactgttgctgagatagctcctcagtctgttgtcgaagtggctcctcaaccgctgatcgaagtggcccctcaagtagctatcgaggtccctgcggttgagattatttcgatcgagtcttctttagctgaagcttccaaggatccagcccctccttccaacggtcttcaggctaacgcctaaattttgtattttctctttccttttgtgaacttgtgtatcagcctgatgtgggctttttttaatacacttcatattaatgaaaaactttttccaagtacatgtgttcttttttcttctttttttttatccgatctcacctaacccgatcttggtttaattgtcatatataggacttcaaaaattttcaagttatatccatgatgaatattatttgactttggttgggtcaactatgaagccgatgtggcttagtggaataagcaaatatcaaaacataagacggtctaactttaggaattaaaatggttaatagtaaatcaatatcaacaaaccgtatatttataatagaggtttgagaagtacctctcatccgatgttgaaatgtgtagttcaggtcttttttgaatcagatgtgatttcaacatctgttgttccatcttttttcctttcatgggcatgtcgtctaggaatttaagtcagaacttaagtctctttgaatggatatccatgaagtacaatctgtagatcaatcataatctataagatgcccatgaggtttaacccagagatcggatatcccacgttagatatttgtgaggttcaatccggagatcagatgtctcacattagatatttgtgagatccaatccggagatcgcgtgtctcacgttaagttgtcctagtttggcattctcatagcccgagttcaactttttctgacctcgtttggacaagcttagttgtttttttatcctcatttggtcggactatatgaccttatttggacaattattttatatcatccatgtttgatcggtttttactgatctcgtttagatgaagaattgttcttcaggatgctctgatttgaacgttagaattcagcctcattttggcaaagattgaaggcttcattgaagagtcattgataatacaatttacagcattccaactacgtggaataattgagctatccaaattctcaattctatatgctcccaagcggattacttcggtaacttggtagggtccttcccaattgggagtacgctttccttgttttgtaggttttgaaacttcagttcggcggagaacaacatcttctttatgaaaaagctttgattttatctgagcattgtaatatctggccaccctttgtttataagttgccatgcagatccgagctttttctctaatttctttaagcaaatctaggttggttctcagccgatctggattacttttctcgtggaatttctccactctagttgatgataggctaatctcaacagaaattacaacttctaccccaaaagtgagtttgaaaggtgtttcttttgttggccctcatggtgtggttctgtaagcctagagaatactatatagttcatctgtccaaagtccttttgctttgataagtcttatttttaaaccttgaagaatggtccgattggtgactcgctttttcgtttgattgcgggtatcccacagaggtaatcctatggtctatgtcaagctcggagcagaattcttttaacttcggattgtcaaattatcgtccattatcagtgataatgatttgaggcaaatcaaagtggcagacaattgattttcagatgaagtctcgcatcttcttttcagtgatttgagccaaaggctctgcttctatccatttgatgaaataatcaatagttaccatcaagaattttctatcctgttgccattggaaaaggtccaagaacatccattccttatatagccaaaggctaaggtgcagtaacgggaatgagttcgactgtaggccgatgttgaatattggcatatctatagcattgatcatatttattaataaaattagctgcatctttttggattgttggctagtaatagccttgtcggatgactttgtatgccagtgacctacccctcaagtgattaccataaattccttcatggatttttcgaagagcatagttagcttttgatagccgtaaacaccaaagtagaaaaaacgaatatggtgtcttatataattgatctccctataagatataccatggagcttgtctcttaattctccttgcttcaataggatctgtcggtagaacttctttggtaatataatcaatcagtggatcaatctagctagtcttatagctaatctgcatgattggaagagtttcgatgctggattttttgaggtagtagataagaatttttagtttgggaaaacctgatgtgcaagatgggataaagcatcagctcgggtattttttgatcttgaaatttgtataacctctaggtcttcgaagtcttttgataatacttttatatgctgtaaatattgggacattataaaatctttagcttcaaattgatctcgtacctatccgacgataagttgcaagttggtaaaaactttgagtcctttgatttcaagttctttcatcattttgagtctgacagttaaggcttcatactcagcaccattgtttgaagcacggtattctgtaccggcctgaattggccgatacatcctgtatcataccattccaatggggaatcggttcgatttagactgatttttcaaaaaataggctgaactggaccaaaccagtgggttcggtatggtatcagcccgaaccactggataccggatggtttggtccggtatggtgtggtacggtatcggttcggtccgatttggtttgactttttttttggccattgaattggattttttttgaattttttattgtcggtacagttcgataaagtacgatacggtatggtatgatatcggttggcaatcgatatgggttttggtatcaagtccgcaaatcttggtttgaagtattgaaattgaatcttaggacattcagggacaataccttcaagattagctaaaattaaaccagctccgctctctttgaaatttgaggctctatcaacatataatacccaataagaatctttaatgatcttttttggactttctgaggttggctcttcatcagggatgatacattccacaatgaagtcagctaatatttgagcttttagtgagggtcgagatcgataatagatgtcaaatttactaagttcaatagcccatatgaccacccaatctgaggtatcaagtcgttgcggaaccgactttagaggttgatcatttaagacgacgattgagtgggcttggaaataaggccgaagtcattggccgatgtaataagagcattgatcatcttttctattttggtatatcgagtttcggcatcttgcagcaatttgctagtataatagatcggtctgtgttcctgcattatctcggactacaattgaactaacagcattaggtgaaatagataaatacatatataattcctcaacttcaactggtttggacaataattggggtgaatcgagatatttcttaaggtcattaaaggcattcaacattctttcgactagctaagtctttaatgtctcaatattttgaagaaagagagatatttcttagttgatctaggaatgaatcgaccgagtgatgccatccattcgataagtcattgtaccttttttattatacttggatactttatttcaagtaatgctcggattttctcgggattagcttctattcctcattgggtcataagaaaatatcaaaaattttctcgatgttacttggaaagctcatttgttaggatttagtttcatttgatgctttcaaagttctccaaatgcttcttctagatcgattatatgccgatctccttcagtgcttttttactaacatgtcgtcaacataaacttttatattacgatcgatctgctatttgaagattttgttgatcagatgctggtacgtagcacttatgtttttaagatcaaaaggcatcattttataataatacaaacctctttcgataacaaagatcgtatttttttatcttctggtgccattttgatctgattatagtcaaaaaatgcatccataaaactcagtaatgtgtctcgaagtagcatcaataaactgatctgttctggggagggaaattatcttttgggcaagttttattaagatcggtgtaatcaatacaaatcctccagttgtcatttgcatttttgaccataacgacattggctatctacttcggatattgggcttctttaatgaatcttgctttcaaaagtttatcgatctcttcatctattgctttgtctttctcaggcgaaatactttttcttttgttggactagtcggtgctccgaatcaacattcaatttatctacaataacattggcagaaattccagtcatgtctgaggctaatcaagcaaagatatcgatatttgtctgaagaaaagatatcggttatttttttaaatcagtccttaattgagatccgatttggatagtcttctctggatgttcattcagtagaatagcaacaagttgttcagctggttcatctcgatttttgccgatatctgtgtcatccttttgatccagcatttcaattggtaaggcttttactggtttcttcatcttggtagatatcaaaaaatattgtcttgcaagcatttggtctacatgcaattcttcaactccatttttcatcgaaaataaaactaacagttgataggtggagattactgctttaagtgcattgagtttaggtcggccaagaatggcattgtaagttgatgatatcttgacaaccagaaagatgagctccacagtagactgttgaggttcttgtattgtggttataggcaaagtgatttctccttcagcagctacgggattttcagagaatccgactagcgggatgtcgacttatttcagcctaacatatgtatttttggaaatgcatcatagaacaatacattagtaaagtttcaattatctactaatatctttcttacatcattttttgttattatcatagaaatgacaatagcattattatgaggagtttggacttcttgaacatcagtatcagaaaaaaaaataacattgtctatatgctgcctctttggaggactttcagctgtcctctgaactccactaaggtctgtgatcatgctaataaccccagcagtaggccgattgtgttcagcatcatcattgggtttctggcactgttcagcaacctggcttgtccgatctcggacatgttgagataactttggcggatcaggacttcaatctcgtccttaagctgtcggcattcttcagtgtcatggccatggtcttgatggaagtggcaatacttttatctctcttcgttggtggagccttcatgagattaggccgatgaagatatccttgatccttgatttcttcagaatctgagcacgagcagacaaaggggtataagtgtcaaaatgccgaggtgggcttcttgacctcgaattcttctaaggtcggctagaaccattctctggccgatctctacgatcctcttcttggggccattttttctcattctcctctttcttcgcttgtcgagttatactttcttcctcagcctgagcatacttttggattcgggttagcatttgatcgtaggtgtccgaaacaaggttttaaatctcgtgggatgggggtgttccagaatctccatggaatggggtgcctcgttgtccgatcccatctcaacagccatttcgatcatgcattccgatagatatcctccatctctctctccttttctcctctttctttttttctttctttttcttttgctttcctttcttttcctttttttcttttcttttggtcatttctttttttctttttcttttcttctctctttcctttcttcctttctttttctgctcccttcttttatttctttcatttttctttttcttctttccttccatctttcgttcttttttttctctttcttcttcttttcctacatagatgagtttcagagtttcgaccccgttccggttccgttttcttatacgaacatgtcgagacggccgagacgccccctgtcccgtcgggatgtaaaattttggtttgaaaaattcttgttaagggagaagatcaggcgattacctcggaatctttattttaagacagctatcgcaacagactcattgaaatttttgacttcaagcatgacgtattgaagtgcactgtatactcacagagggactcaccctcctattgcttaatagaaaaaaagattatttgtattcttcagatgaagtcagttattagcgaaataagtgacaaacagtttggctaactgctcaaagaaagaaatagaccccggttggagtccagaaaatcgtatccttgcagattttttgagtaatggggaaagtgatgcaaagcaaggcatcagatgcctcttgtagcctcatagcagctctatatcctttaagatgatctagaagattagtagaaccatcaaatgattctaccattggcatcttgaatggggaaggtataacgttcattcaaaatttcttgagaaaaaagggatcgtaggtcaaaatcttgcttatcttgggaatgattcccaagttatacttccatcagccgtttttcaagatcttgaattttcatttcaagacctctccagcgtggtttcccactatcaggaatagatttcccttcaaaagattggtcaatttgagtagggtgattatcaggatggggatcttgatggattggctgatgattgtgttgggacagaactttttgaggaattgcctctcattgctgttttatggtacattggagttgttgtacggcaacagtgagagcctgcacttgttgaattaaaagagtgattgctgtggatcgaccataactgaaggttgaatagcttctggtccgcctcttggagaagatggtgaaggcagagaattattgtgctttctaatttaccatttttcacaatcttttgggcaagcctttcctttagcgcaaacttgttgctgcaaggcttcaaaggaagaacagtgaggttggtcaagaatccagctggagtgctgaagaggatcaagttgacgaagttcgtagatgatcctacaatagaagtcctaaaaccagtgcggtaccctctggtttaggacccttcgatgcttaagtcagcagggaccttgagaacagatagtataaaaatggaaaatagaaaaaaatagggtagagagagtagaaaggaatagagagagctcagattcccttcagtgggggagagaattcaacagagttttgactctgtgagttctgacttacctctggagggatccctgcttccttttatataggggaggttacttagctgttaagtcatggagagagtttgttaggtcgttagtaactgcttgagtcggagaatctgttggttaggccgttagttgttataacagaatggtcagctataaagagatcgtgggttgttattcacctacgtggagtatagctgtagcacagttggagagtagctgatttagaatatatttgatcttgaagagatcggtaaaggccaatgtccctgatagcaggtcggtagctgactcggtcaaccacaatacaagattgatagacacctcgggctggttcagattgacataaaactgatcagatcggcaacataccaattcttcctagtacgaccagatggtctgaggttactttatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaagcaaaacatgttaataaaatggcgtagcctgtactttatacaatttatcaacttccacaaactcatcatttagtcagcattgaaatcaataaaccttctacactttaatgtcaatatcacaaaatccaaaatcatccattcattgaagatttacactataaaaggaaagaaaagcttccccctctttctgggaggtatcacggaagtacattgagtgtatctgtgaagtatatggagctttttttaaaaaaataaaaataaaaatatgcttaacttaactattggcatgtattcttgaagcattggacaagtattgatttctgacatggacatggcatgcaatgtgaagttgctttgtagatggttagaggtgtagtcagaatggcaaacttagacagctatccaatcttgctaggacagattggttaaagaatatgttgagattcattgagcatggagtgaataaaatcttagtgtaacctattccattttatgactttccttcgttttgcttgtggttgggtttccatgtaatctgaatggcatgcttttagttattagatttcaatctcttgattgaactacatgctgcctaaaagaaaataaaagcatgatttttttaatcttcatgttagtatctctaaaagaagtagaattttatggtttttaaactatggcttggatgttaacagataatgaagctgccttgcatgaaaattctgtggaaggaagacttgaaggtttgctattccttaagagttattttttccctaagttcaatttagaatcagtgtaacttagttcaaggagatgtttaatatggttcttcattgtagtattttgttttatggtgttgcttcatcttttcattgtaaaatgcctaaggcctttgatttggactttcctatattttaattatgctcattctaacttcattgaatttattattcagttgttgttgtgtcttagttatatacacttatgtcatcaggatttaatgagcttgacattgtaagttgctgttcttgtgtagctaatgttctctcatcagttatctagtgttctcaaaagatacagcttattgatttccacttaatatacatcaatgaactctttttatatcttttgagagagaaatttaactttgcattgttgctttttgagcatctgctgatggttaatcctaagatttagttttttattggtgggatgggaagaagattaattcttagagattctagaagcttattatttttttcttgcttcttataatgcatggttgttgcttcttggcatctttttttttttaatcccaacttttttctgggcacatctttcattttttgactccttttttaagccaggtttgctcatcattcacttatttgatttttattgtctttatttatttatttatttatttatgatatactcaaacaggagtcatcaagctaaacttgttcctttttctggttgaaatggattaaataatttttttcacatagatgttttgaactgtcataggtgtttgaatctgcccttgtagatgtctgctcaaccatttagcttagttaataccagtattccatgttccggtctaagaatcagttagtataaggatttctcctttgaatcaaatgaacctattgccgctagtcttttgacctaggtcagctcagttggaaaagggtgacggttgttgttgtgtagcaacggcagaacctacaaaataagtctctgattggagttggcttcgatggggaccctttgatgctcaagtcagaaaaatcagaaatagatgggaaggagtgagcaagggagagttgagagcatatgtgggaggtctcctgtgggcctttatttataggtagaggctgaggtgttgtgaggaggaaggagaatcatgccgttattccttattgggtgtgatacattcattatgtcctaccttatctgatgagatatgtttgttaccctcttgccttatctgcttgtggtagattgttgtcggtaatcatgggattttccggcccatgtaattgaggtagcagttcaaaagtaaaacttactaggaatgccgacttggatcaattgggaaagtaccttggatcagtgaccaaaggtcagccacatttgaggcatccatacaccgattgaatcgaggtgaaattttcctccccatatcagatgcccccccaaatctcgagtctgggctaaaattcggttggatgaagagagtagattggttcacttggctctgtgagcgactcgtgttacgtcgaaactaatcggtatgaagcatcatgtcttcgccctgtaccagatgaagtgtcacatctcttgattggctatccgtgggaggtcagtccggccaatcagagagtgacaggtgttaaccatctaacggggctagccaaaccaatgctccatctgagctatctgatccctttcattttcacatttactgtttctttgctgttggctttgaggtggcgagggatttttgacaagggcttgggactccttccgacggcactctggcatccttctcggtaactggtcctaggtcaacttcggctcggcattgtttccgatcctccctaatccttcactttttgttcctctatttgccttctttttgggccttttccctctcttctttttttttctttgtttcttcatttggtatctcaggatgagcggtgaggcaggctcggctgggagttggtcgtctgatcaatgcccacctcgaagccccaaagccaccttgtccttggaatacagccccacgagatccaaggctaggcatcaggatgaagaggagacatttattcccagatattttgagtcggtactaggtgcagacgacctaaaactaatccgagctcagttttgggttcatttgagtaccaattggaagctccaggtccgaatggtcagagctgtgaccctcgttcaggttggctcggactttcctgagccgacgagctggcctaagactcccacttcatccttttttggttcgtcttttttgtttccttgatatgtcgctaggttcagtaatgccgaactcttggtgatttatttgcaactttatagccgcatgttttcttactgaggttaaaccgaccatcactctagttagggcatgcttaactttcaagaggcacacttgcgtgggtgactagtgatatgtctcacctcaaagaggggttcgccagctccgaggtgctccttcctcagtttacaattggaaggagcggttccttttcttctgtttcattcggggaggattggggctttgccccatggggacctaggaggtccgtacttcgggacccggccttaggagatgatgaggaccaagatttcaagattctgacccgttttaagatcccaccagttaaggagttgcttatcgagaagacactttaacatcgggttaagctaggctgactcattaggtgactcaatcttccccgctttctctttcctttcttctttgcctctttttttagaccaactttggttcgatgcagaaataaggttggagttggacaaagtcagaaaggtggcacaaaagaggaagaaggctttgggtgccaccatggctcaatcgaagcgcccgcgtgctgaagcttttgagggtcgatctggcccgattccggcacagggctgtccggccgtagggagctcatttgcttatactgacatggtcctcgcttatctggttgggtccctccactgagggcccgacattgcttcgatcttcatcccctgccccccgagaagggggcctttggagtcatctccttgccttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcctggagttatgccggctgaaggtccatgagtgcttcctcgagctggacctctctttcttggacgaggacaacgacgtccttattgaagccccgaccccgagaccgccaccgtcgatgctgccactactctagctgctgaggatgctccctttcgagccgaggatgccactactcccgaggcttagaattgcctcgttttgtctttttattttgttttgtaatttggattggccaatcttttgtaccagagtaatattaatggaatgcattttcattcaaaccttgttgtatgatgagctgacttgttagtagaaagattcttaagttctaatccttgggatgaattgtcgaatttgcaagtcgaactgacctattaatctttagtagaaggaaatttccaagttttgatcctcagaaagaatcgttggtttagatagcttggaggttaccttagctgaagtgagggaggtttgggatccttactcgggcaattcgtaggtcaatgagatcgtggcatagccttcacattggttggacatcccaaaacggacctaaagcttgaagattaggtcgtcagattcgaattgtccaaactttcctttttggggttgaccattgttggcaaaatttaaggccttcagcttggctcgacttgggtcatagctccaagcttattgaaggggttctccgttcaacttttcgaggcattcagcttggatcattgagactatggtattccaaaccagccggtacatcccgtaccaaaccataccaatggggagctggtccgatttagactgggtttttgaaaaatgggctgaacaagattgaaccgatcggttcagtacggtattggcccgaaccgtccgatgtcatgcggtttgatccaattcggtatggttcgaagctggtttgattcggttcggtctagtttttttttagtgctggtggatgggatttttttgaattttttattattgatgtggtatgatatagtccggtatggtacgataccatactgatcggcaatcgatataggttttggtatcaagtccacgaactttaatagagacgaaggacagctttaagtcaagttggcattggtgatgtccaggacttctgaggttcccattgtggtttatccttcctcgttcattgggcggttaagtgttttgctttgctcgtcttaggcttgtggattgagttggctttgccgatatatggagcttccgaggatcctcttaaggggttatccatcgcttctcaaatgattaagatttttagctccgccatcagggataaggggctattcgagggtcctcttatgggattatttcttgcttctaggttgtgcagggtctttagctcgaatcatcacggataaggttttggagcttccaagggtcctcttatgaggtttttcctcgcttctcgaatgactaaggctttcagcttagcttgtcttaggggtggggttatccgagggttcttttatggagttatccctcgctttttggtcacctgaggtcttcggcttaagtcgtcatggataagattttggagcttccaaggatccttttatggggttatgcctcactttttgaacgatcaagatttttagctcagctcatctaaggataaggggttatctgagggtccttttatggggttacccttggcattttggttgctcaggatcttcgacccaaatcatggatgagatttagaaaatgaatttatcttgttaagcttgttaatgaaagaaatttacttcttattgaagaaaatggccattacattattgataatatatccataggtttttcgaattccatgatcgacgtaatggggttccatggagttgctttaagtgataagttccgaccatgatgaccttatccacttgatagggtcctttccaattgggggatagcttcccttggtcatctggctgatgtaccttggcttggtgcagcaccaaattgtcgattctgaacatttttcttttgacctgggaattatagaattgagccaccttgcattggtatgttgtcatcctcactctggcttgttcttggatttctttgagcagaaccaaatttgcttgtagttatttcaagttactttgctcgtcaaagttctctacccaaggtgatgggatatcgatttcgataggaatcacaactttcatcttgaaggcgaggttgaagggagtttcgtcagtagaaattcattggatagttcgataggtccagagtatgtgatgaagctcatccgctcaagatccattggcccgatccaaccttgtctttaggccttgcaaaagagttcagttggttaactcggcctccctattagcttgaggatgacctatcgaggttagacgatgggtgatgcccagctctttgcaaaatttggcaaataaagcattgctgaattgtcggtcgttgtctgtgatcagtacttagtaaatgccgaaccgacatatggacttccagacgcgtcgcttactctggcttcggtaatgtgagctaatggttcggtctcaacacatttggtgaagtagttgatggcgaccaatagaaatttctgttggctcgacgcttggaggaatggctcgaggatatccatcccccaatgtgcgaagggccaaggtgctccaatagaggtcagtggcacggtaggtcattgttgaatattggctttctactgacttggtcacatcttcttactaactcggctacatcatgttgtaaggtcgactagtaatacccctctcgaagtatctcgtaggccatggttctgcccttagggcctagatgattttcacatatctcttcatgtacttttcttaatgcatagtcggctccagatggacacaggcacttgagaaaaggtaagaagaacaatcttttttatagcttgtcctcgtagaggacacaatgtggtgtttgatgtcttatcttctaaggttcttttaggccagtcgagagcatcccatctttgaggtagtggactaggggatcgatcagctcagtttggcatcgacctgcagcatcgaagtgggctcctcgatgctaggcctctccaagacttcaaaagaggattccttgtgtgggcaaccagtgcagaggctgcaagcttcaacagtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagggtggtgtcggattgcggagtaggggattgtcttctttcttggttggggtttttgagttggctaagccaactttgcttctcccattacgggttatgcagaggagcctaaggtggtgttagctaaggcgccttttgaggtgctgtgttggcctgctgcatcacttgaactgtcgcagcaagcatctgcacttgttggacaagcagattaaactagtcaggggccaccccaccgtcgattgggaggatggagacggtgcttccgattgttgcattgatgtttgagcattggtggaaacctcgatcgatcttgaggtagtggcattggaacggcacgacgaagttcttttgcatggtgccatgccgataggatgcttgctccttgtgagtgggcttggcccttcctctggtgccaatatgttgctgctggttttttgatttggatcggcttggttggaaaagggcggcagatgctgtagcgtagtgacagcaaaatctgtaaaataagttcctaatcggagttggctccggcgaggatccttcaacactcaaatcagaaaaatcgggaataaaggagaataagtgagcgagggagagttgagagcatacctgaggaaaggttccctataggcctctatttataggcagaggttgaggtaccgtgaggaggaaggagaatcaggctattattctttaccttatcgggcacgatatgtttgttatctcctgctttatttggtgagatatgtttgttatctcctgtcttatttactcgtggcaggttgttgctgataatcacgggattctccagcctgcgcaatttagatagcagttcaaaagcaaaacttattaagaatgccggctcgggttggttgggaagcaccttggatcggtcaagacttaaggtcagccatgtctgaggcatccatacaccggctaaactgaggtgaaattttcctcccagtatcagaaccctatgtgggtgaaacaattgcactgggcaacttggtgtgtttgcactaagaagaccatgctagagtcttagcaactgcatattggtagctcaggcacgagataaaggagacattttggcctgtcgtgtgggagttctgttctacattttgtgtaaaagtttactacttcatgtgtctctatatgattttgatggttgggcattggaactttgggaaggaaacaattattgcttcatgcacttttgatatgaatattcatagaaaaagagaattgcacaatgtctttgaactttaaactgttgctctggtatatcaggaaatgaagctgccttctgtgagattgctgcagaagaaaaaccagaacatttgccaagttatatgaatttacttattcaaactaagttcaaacactttgtatataaaccttaagtttgttagattttgttctggctgcatcaacctttcagtgaagctactattgcttttttagtttcaagtcatttcttccttcaaattaaataatttcttttctcatgtcttacacactactctctacttcatcttgggatgtcaattcttttatggatcattttggtttctgatggaacatgtgcatgtgttatttcattttctaattattttagttttacagccgcacggatgttacctttgttgttttttacatctagtcatttcagttaaatccttatgttcttttgttatttgccactcttggaccgaccgtcagttttccatagtttctagacagttcttacattatgcaaggaattatcattccatatgaaaatgttgtacttttctttttcctttttattttgtggaagaataattagactgactactaagggaatgctagtaattttctcattcacccagccaaattacttgagattactttgcttgaaactgaacaatatttgttgtatagtaactggctcacctgattctttctaatctgctttggggtctctctctctctatctctaatttggctatgttcaaaagactctgtagttagtattgctttgttcactctcaaatctgccttccgaaattgttatatgtgatttggcagggaatgaagcttcttccaatgagacagctaataatgaagaagttgaaggttcttatgactcagcttctttttttttccatggttaataaatcttttccattcaagaatctaaaagctgctatgcttgacatgatagggatgggagctgcaccaaaagtctctggacagcttgttataggtggaactcctacataattcttgatcaacgtttcggacttattttcttgtttagaagtgcatataaatgcagtatcctatcaagcatgcggtattccatatcagatgtctagtcacgtagaaatgggtattgcttagttaatgttggaaaatttagcttgtgaatccagcttagcagttggtatccttggagcttgaagttcactgatagggactggatcttccatctgatgactgcatatattgttgttcatctggtttatttctttggagattctgtttaaattctaaagtatgtcatggcttcagtttgcgtcagttattagatacttctttttctagcttcttattgctcttatggccgtcttttcttatttgatagagttgatatcttaataaattaagtgctgttactgaactagcagggaatagaattttctgcctaagaagtttaaatgcaaagtgcttgtatttctctaatctgttaggactgtttatgagcaatgatattttctgtgcattgtcaatatttttttggcattgcgcatgcccaattttcgtatccacatgggcctctcttgaaaggttaaggaatccgatattccaagtcatggagatttatgacttaaatgaatcacaagctttgcacctatttgttttttttctgtcatttctcatctgcagtttgtgttttaggtgtttaattattgttattagatcttttgctggctgatgaaagggagaaagcatgttaaatgctgtcagtattacatatgtttccaatgcaaccccaagtttggaagctacttatggctaggatgttccaaatggctgtagccactctgtttcatggtagaatcgtcctatgaaaattgatttccaatacacatcccacagggacatggtatgtggttttgagttgtctggacttcgtatgtaattagcctcatggaattagttggtttgggagatatgattatgctatagggctcttgaaatttaactcaggcttttacaggtctggtgaaaaacatggataaattttaggtttcctagaacttcttcgctgacaaaaagctatttcagactgaaatgttgggaacaaaagagtaaggaaggatctacaagaaatggttggattctgccttagttttacaagtctaaggtaaacgaggttgttactggtttacttcagagacagaagtggtttagaaattaaccagaaaagatagaaggaagttgataacttagaagctgtcatcttaggagttcttaagtaggtctgcaggaatcaggtgcatataataattattgaaagaagagacagaaaacatcttaaattattgaagtgtatcatacgcaaggggactgaatgattggggcggatcaacatatcagcagattgctggtaccttctagctttaggaacacaaaacacaaaatgtccagaaatccttcttcccaaggagagagtaaaagctgacaattgaaaaaaaggtgaagaaggaacttaaaaaattctggtcactgtggggttctgtagacaaagagagctaaaacactcaaaaactgagtctaaattattctagtaattcctgagagctatgactttatcgggacattagacaaaagtccagagctataactcggtcaaaaggatcctaaaataatatgctaaaggcagtgccaatcaaagggtacaaagcacacctactgtttcattctctactaatgcacgacctttaagatcatatgaaacccattgattctccaagaaatcctggcttttattaggaattctgttttggagttaaacccaattaaatgtgggagtcctgtcagcctgttcgaaataagcaggctaagtgataaatgaaacttcaaaacactgccttaattcaggaacaacaaaagctaacctcctgccccttcctccttatcttttgatcagtccattcatatactttcaagtttccttttgtttttctcctttcatcttcttactgcatgagggtttccattattcctattactgtttctattattactgtattttctgttgcaagctggcttaacaccatcccccctttatatctcatatttaatggaataacagtttggaccatgaatacagaaagaaagcatttatcgcttttccatattgacatattgtttgcattaggtatttgtgttccatggatgaagaggtatattcctttcactcgaagtgacatcactcttctttgcagaaagtgaaccactcaagttgagtgtaataaatgaaaacagcagaaccagccagataatcgaaattgtagaggataaagaaattccaaggtaccagatgactgcagatgtaccgatcattgatttagatgaagatgaagatgactgctcaactgccttaaaggaaaatgatccattaacaacagatacctgctataagattgttgaagcagtgatctctgacaggcagaaaatatggcactatattgacccttcagggaatgaacagggaccgtttgcattggcttcgctgagatactggaaggaagaaggcttctttgatgatgacttcagagtgtggagagcaggtcaatccaaagaggatgcgatcttgttgatagatgccctccgttgaagtcataattgctgactatttttacatgcagaatctgaaggcgtagatcattaattgtctcacccattttgtagaatgctctccccaatttcctctatacaaaaaatgagtgttgaattttgttcatgtaaaaagcagtcatgtgatggcaaaaaaaaataccattcaatgatatactgttaaatccccgaagaatttgctgttgctgttgtctaatctgagctttatttcgtttccatcacatcctgaagaattatgtgactgggcggaggttaaacagggaatttaaagaattttgctgctgaatattgttctggtggtactcatctgcagtcagttctttgataaagtcagcactttattttcagggtattctacattttcggatgttgcttctgttccttgtcttgagttgcagcttacaatttctgatgtgcacaaatcctggatgtcactttaggaacaaaactgatttcccaggtttgtagagaacaaagaggctgaccaaatctcagtgcatggctttcataacaccccattcctcgtattctgaaaatggatttgcagatcaaactaggtgaacaactataacttatcctagctgcaaatgcttcacattagcatataaatccaggtatgacttaccaaagtctgtgaatgtatgatgatcagcctttactttacactcatcctttgtgacttgtcagttaatatgtttctcaagctatttcaggcaaaatgcggctgcaataaaatctacattctcttaatggataggatatactggcattgtggtatagtatataaatttcattaaaagtttcattcatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtgtataatttcgtgggtatggaacccttgtgtgactaccattatgttctccttacttttaccagccttaactagaagataaccaggataatgttgagaaaaactaaaaagaaaaagccctcaaatctatccatgcctcctgccaaggtccaagggttttagccatctggaccccatcgtataaaacccccctctcctccccaaaacctaaccaaagtagtagggttttcgactcctggttctctctcgttatcaggaggaggagagcactcatcatatccccatgtcgttgtaccgccacctcctccgctccctccaccgcgccgccgacccacggcctctcgtgatcgcccgccccttcgccttttcctccgccgaggaggccgccgccgagcggcggcggcgcaagcggcgcctccgcatcgagccccccctccacgccctccggcgcgacccttccaccccgccccccacgcgatcccaacgccccccgcctccccgactccacctccgccctcgttggcccccggcttaacctccacaaccgcgtccagtccctcatccgttcgggggaccttgactccgcctccggcaccgcccgccacgctgtcttctcctccgtccgccctaccgtcttcacctgcaacgccgtcatggcctccatgctccgcgcccgccgcctcgacgacgtcgtcgccctcttcaccttcttcttcaaccagtccaacatcgtccccaacgtcgtctcctacaacatcctcatcaacacccactgcgacgccggccgcgttgataccgcccttgacgtctaccgccacatccttgaccacgcccccttctcgccctccccggtcacctatcgccacctcaccaagggcctcgtcgacgccgaccgcatacaggacgccatggacttcctccgcgagatgctcaaccgtggccacgccgccgactccctcgtctacaacaccctcatggccgccttgatcgaccgcggcaacatggacaaggcccttgagctcttcgacgagctccgcgagcgctgcctcgtctatgatggcgtcgtccacgccacccttatggagggctattggaagcgcggtatggacaaggaggccatggagtcctaccagaccctccttgaccgccagttcaagatgagccctgccacctgcaataccctcatagagaccttgctgaagcacgacaagcgggccgaggccaacaagctcttcgagcacatgctcgacaaccacacgcctcccagctttgccgccatcaacaccgacacctacaatctcatggtgaatcagtgcttcaaggaaggaaagtttttggaggccatcgaggtgttccaccggacagggaagaagccatgcgtgatggatgtcggctgtttcaacaacatcattggaaagctctgtgaaaatggccttctttcagaagcagagaagctgttcgaagaaatgcctgggaaatcggtgaatccagatgcggtgacctatgggtttttggttgacacatgtttcagagaaggaaaagtggatgatgccgtgcggtattttgagaagatggtgaacactgtagaaggggctccaaaagttgatgtggggttctacaacaaaatgtttgatgtgttggtcaaggcaggatcaatcggtcatgcactggagatttttgggaagatgggggagagagcacttaggccggattcagctagttatgagattttagttagagggctgtgcgaggaaggaaacctgaaccaaggacgggatttgctggagcagatggtgaggtgcagaataactgtgtcacctgagttccataggtttttattggatgcttttggtaaagcaggacgaggtgatgagatagaacatctgttcattgggaatgcaggcaatgttcctcctcaattccaacaggtagcaacctgaactagaatattctatgcttcataaagcccttctccaccattcatgatggaagaaactgaactgacttcttagagtataaatttgaagcgagttgttttcctctcgggagatagtattgaagtattagggtctggtggtaattgttgtgtcttcctatgaactgtgctatctgatccataatatttatgattttggtgtatgaacatattgaaaatgatttagtccatgtcctaaagctttatcagtttgtctagtaaaagcgcatgagtgattcattggtgatacattatatgttttccctttcgtacatgtgctgttgatttaatatgttgtctcttcattttgtttgtgttttaaaatttggtcagcaacatttttgtcaaataacttctctcgttttggaggaaatactaactttaatttggttgcttgcaattgttattataagttttcttttaaaaggtaaataaactagtagaatgtatgacatatgtttgtcatgttatgtcacagctgtatattcatcatttattttcatagaaatctatcatctgcaaaggctaaaatcaactatagaaagcatttctgtatgctagataagctttgttataagtggaaaagtttctgttttgcgcactttataatacaagatatctccttgagcaaggagatgtctttaactcttatttcttttgttttttatttgtccaaatatgtctaaatcactgtgtgtggagcaatattaagctgtgaatagatctcacaagcatgcttacaaaacaaaattaatgctcagcacactcaagatttccatctatgggtggtttgcaaggtaggcatgtggcttccacacctaatcacaagcaattagatgctaacctctattcttgggttcattttgacattagtttgttattgtgttaatactttgtttcaaacatcactatgcaaaatgcaagaccatgtgcacccctgatgaaggggagaaaaaaaaaggaaaaagaagtgtgaaaggttaacagtcagtcactactcagttctccaatcttatgggtgatcagttgaatggtacccatggccccaatgaagaaccatccacactgtgtactgcaccaactccagctgccacagaggaccaatgaactgagcaataactggatggtgatgtctaacaatactcaaaaaccatgaacgataaaaaggtcttgcattaacccaatgaattcatgaattaaccttgcatgggaagtcttttttttttccttgtgacaatatggaatgtgaaagaaaccattcatggagaggggttagtatgactgaattagtaatagggaggatctaaatgctactgaccaatgttgtcatgggtttcaaaaaggaattctatatggttgagaatcttctgaagtaagaggtgttatggttggattatgaaggaatatgtgatgatctgtttctttgaaggttgttttctcataattatgatggtgagatgtggagatcaggactgggtgatgaacgacatcattcatgactttctgataggtggtagcacttatgctaagttacatggagggactgatgggtttttagtgctgtgcaaggtgtacagtgtatgtctcttgcgactatgctccctggacacctaacttctttccttgctctgcgagctgcttatcaggttccacatgtgagccacaaagttaggtacactgtgtagtgcatggtgtgggcaagtgtttagatctacagaatcttgcatctctagcatgtgtctgggttcagcaacgtgtattatgtttttgtgatttgttgttaaaaacacgggatgtagcatggcttgaccaatgaaatcctttaaaattagaaaggtcttgattgatagagcaaatggaggtgcaatctcctccctttgtgatttggtgagaaattttggttgattagaattgtctccatgcatatatgcctgaggtctcatctgcagtgaatataatactactaattcccttcactgaagtatttaaggaaacaaggaaatatgtattcattcaaattcattggacatcaagtttggccttcttggagcattctgtatcataacaaccttagttgttctccatgttagcaaggatctgattatatgtcctgagtaatcatccaataattcatttgtattatcctacagagttttcctttagaataataccatcgtaggttacttgaagaaacatttcatgctttctaatgctaattgataattgcctttgagccactcctacttatctatattggaagacaaatatctagtttattgatgccttgaagaggtacatgttatttgttggaaaatactcaaatggccattttgcatttcttagcttgtggtagcaagtgacaatgggcattcaagacaaatagataatgggttgagaggaagggtttcggtgaagttgggagaggaagctagtgagtttattacaatgtctgatgagaacctgagtgaaacaagggtgatacaaggggattttcttttgttcttgtggtagattcactcactttgctcaaagagaagctcaaagagagttcatatttttcttatgcaagcaatctaagtgcaagttagcttttaactaaagctgatgtagttttagccctgcttagcttatcaaatttataagaaaaaggatgaaatgcttaggcctgacaaatacattaggaaacacagttgggggagaagttatgccctctttgttgcaccctttgcatatgcaaagtgattatgtaaatgctatctgcatcctgtaattacatatgaaggagaatcaagtgaatatggggatggtggtggatgttgttgcctggggaatcaagagtgcatatggttgtgtgattggaaatggacaattgacagccattgtctgctgtagctacactaggcagctctatgcgacaaagatggtaataagacctgaaattttgtaaggttggtatgtctaaggaccctattttgggtggggaactatttttcaccatggtgatttctccagtagaagtcaaaaaactaaagaccatcattgctggtgcatagattaattgagacttttttagtgaggtagtgatccagtgatgagtttgtcaaggcagtcatgttgtcgaaatatctgcatccacagtgatgaataaggacatggaagatacagtgacatgcaggacacgtggttgttgtactttatattttgacaatttgacattgcaaggataattgttgtgtctcccttgttcttttcggcataaattattgttgatgatgctttttataggataattgtgatgcctcccttgttctttttggcatagattgttgttgatgatgctgtactttctaaactttattttaaaggaggttatgctgctgattaggtgttggatagggatgggaagggtaggatggtcaatagagtgggtgtcgatgcaatcaataagctatgctttttattggcatgatggctgtaggtagctattttcttaaaaatgtttagcaagttgtttttgctgctaagttggcagttgcagtacttctcatgcagtgaagtggaagctaacttggtgagtctccatatgttgcaatttgtagggtatgggtggcagatattggtaacttagatatgtggcgatttgttgaatccaaaattcatcaaatagaaaggcggttcacaaaggagaagagagtatactaggattcaacctcaaacaaatatcttttgaatgaattcatcactaaaagattgggatgcctcagcaccatataaacaaacttgttttgaatcattgacgggaccagaaaattccaatcttgaagtaaaacttaagagaaaccataacaatggatataagcaatctagccctatccctcatttatacaggaggcagtaaaggaggctatagagttgaatgatttggatgtagtcttggattgttttatttttcttctcaagaaattagaaaagatactaatatattgttctggttgactgtgtgatgttggtaggttgttctgtataggtggaaagtttacagtttaaaggtgcagttctagagttgaacatatcgtcagcctcctaaatgctgtcatattgaattttggagaatttgagtcttggcatggttatatctaaagaagcatattatttgataagttcaattttttccatgactttcttacacaaaagactattagttgcaatattatgaccagaaaaaagttgcatataaggcctttgttataaagataagattatttcttgtgatattagtctagaaaaagttgtatttaaggccttgtcaaggtttttatgaggatcatctctgcttgccctagtgaagcaagtgaagttcatgaaaaagtatcttttagttgggtatttctccttacaaagtctcattgttggaattttgctactggaacttttgctagatgcacggtctgattcactgagattgtcaccaggacggtgtttaaaaagttgaggtgaaagtactattttggcatccctcttatttgtttaaacccagagtcattcaccgaaggaagcaagagattgcaaagaaatcactggcagttgcttatgttgatgaggctcccttctctcttacatgtagttcttcaaaaatgattcagacatacatatacccagtaatgtaccaatatcaataaccagatatagttattcattagatagagcctgtgctaagagcagtcacgggtcatttcattgtatgccagttaattctgttctcaaatattatgcactagattgtcttcagtgacgtgacttatttctgctgcagtaactaaaagagcttcacagatgtgtgatacgttctcattatcatggtcaattagatggaagctattgttgagaagaaacgcgaagcattgtttgccacagctgttccatccacaatatatcgttggacatgcaacataacttcacttatttatatcctcatgattcatctgtatacctttttcagtttttacagctctaattcctaaaatttgttcctacatcttggttatgtatgggataccatgattagaccattatatgctcttggtacataaaaatatttttgctccggacgtgcttacctcttcttatctgaaatttcttgtatccttgagggcgagcaaacttatctaaggcctacttattatgtaagatttatcgggcaagaaatgctttgggatcaatatgggaattagggggtgtgtggttggggcaattaagatttagaataggaatcggaatggatgactcctattttaactgtttggttgtggagaagctttttctgattctcattccaaagaggaatagaaatggtccaatctctcctcagttcaattcggattcttgttggattgagatctcattccaccggaatgataattaaaaaaaaatatcaaaatcgacatgttttagctcgatgtcgtcgtggaggtgatcggtggcaggggcagcgttgggatcattaagttcgatctcagtcttacggccataggaggcagtcgggcgaaaggagtggaagacgagacaataggagaagcgggcagcgagggagggggagaaggcggcgagttgggaggggagagaaagggggctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgctaactaggaatttgagattggatttattttttttacttaaaagaaaaaagttgtgggccaccctttattagtatggatggattagttttttttttaatttttaattaaaaataaaaaataaaattttgagttgattctgatttcattctttgtatgaaccaaataacaataataagaatcatctattccgattttgattctggatatgaatcaaatgcttcagaggattaggtcattccaattccgatttcaatctttcgattctcatttcaatttcaattttgattgcgaaccaaacattctcttaatgtgttttttaatctacagtatcaactctctttagtctgaagccaggttggttgggtgatactctggcctagtgctgctgtgctaagtctgataagctctagcatctaatgctctatcaattttactgtattgtcattatattttgattgaagtatgtgaacatgattaatgcttaaatttttgtttatcttcttcacttgagatgagttataatcaattatccatatccatccgagttaactggatgagagttaatcttgtaacgtttgtagaatctgttaccttttcttgaaatgaggaaaaacttgatggattgcaaaagtagcaaggataaataggggctttgatcactcttccactccatcaacagaaagtgtccttagagagggccatcaatactctgatcaaagagtggcaaaagaaggccaatatgctggactccctctacgattcatgacaagtttaagagctgtagaataattactgaaagtatatagtataatttctgattttgcttaaccttgagaacaatattttggagagagaagaactaagaaaatcaggaaaattgggttggataacttagctgttgctgtttaatttttattttaatttaattcaaaaaatcttttgattgctatcaggataatccctctccttatggagattaaagtactctgttgactttaatggtctgtttttttttttgattagtcttcagccatccttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgattttcaataaaaataaattcaaacataaatgataagattgcaagtataaagcacaaaaaataagtaaagagaggcaagcacaacaaacacaaagaatttatagtggttcggtgccaaccttgcacctacatccactccccaagtccctacttgaaaattcaattcactaaatggatttcaaggattataccacgtcggacacttccaactcttactatccaagtaagaatacttattttttaggtacaaccaatcctcaacaatttaattcaagattcggatcaatccaaccgaattttggaacccccaaaactcaaaaaaatccaaatacaatataagaaaaatatggtatagaaaattcagcacaatatccccttaaatagacacaataaatataatagaaatataatacttaagaggaagaagcttttgctaaacatcctcaatggattgcacatttgattgctgctggagagtggttggtgaagtgattaaatacttctatttctctctttagggctgatagagcttttctcgaatttaaacttgaatacttgcttaattttataattttttacttcaaaagagtatttatagtcaccatttacccttgagaatgtcttagagttagtttagagctgttggagagtgtttaatacgcattaaatgcatcaaaaatggattgaaaattagccgttacgaactcatccaaaatggatcgtcctattgtgactgaaaagtcccatgagctgcctcatttggccagtcaaaaaattagattttctgttttgatcttagggtctcaggggtcgttccaggtgagtcatcccactgtatgagttgtcccaagtaggtcgtcccactgcgtgtcatgagccaaaatgaaacgtaccagttactcaataaaaatagatgattcagatgggtcgctccattttgttgcaactcaatttttcatacatttaaggttcgaaacttaccagaacactttcaaacgctctcagatggcttcaaatcaattggacactcttagaaagcttcgaaaacttcttcaacttgcagaaacttcaactttgacacacttgatgaagcttttcaaatccaatattttagactgtctgaaacattacaagaacattcttcaaagataaaaaaatacattagtagtccctcaaatggtttatgatcatcaaaatcaattcttggagcaacaataatatattaatatagttgtatatttttcttatagttaatgattgctgtacaaaattatataggattatacgtagagtcagatattcggatatggatcgaatagttatctatctatattcatatctattttttttaataaatatgaatatagatatggatattaatcgaatatttaaatttctatctatagatttagatatgaaaatagatctagatggatattctccatatcacgttcacccctgccatgcaacaatagcttcaaatattatcccaataatgaataaaacaagtataaagataagtattttctaacttttttctatgagataatggatccaaacagccacattagaatgtgtgtctttctatatttgggcttagtatggtaccacatagaattggatcttttccttatgaaatttttgtttgtatatagaagagcactagtgtagatatagaaaatcggagggacaggaggttttgattgggtgagaatgagcatattaggacaaagggataggggttcctctctcttcggtctcaatccaatcatcgacctttattctcttcctctaggatgagagttttgattatgataaggaagctggagttggtgttattcaactcgatgatgaagtagaagacattcaagccgttggtggagagaaaggtggggatgtatgtctgtagcgtcactccttatacttatattcctgcacctatatggctttcaacatcgatccaaccctcatcattttcctcttaatctttgatattattttttttgcattattttgattgcattctatttagatttcttgaatttgattattaaacaataattatttttcaataatattattttttaaataattaataattatgaaaataatattttaaatatgatatatattttaaataaaaaaatatcccatgcgatctagttacaatgaagaaccaacacaaacacttaaaatatgttctgaaggccaatgtaccaatgctaccaaaaaaaaaaagaccaatgtatcaatacaacacaaattgtacaaaatattagaactatcaaaatgagtcaggcccatgggctagcccatttggccctaaaaatggaccagattaggctgagaaatcctgacccatgtatgaaagtaggctttttagcccgacccctatagcccatggattgaactgggttaggatcgggtcagcctgtggcctggcccctcctgtcaggcccctcacccttcccctccccatccacccttccctccctcaccggcatcgagaatgtacgcgacctctctccccaaaactccgccgccactgccctcatccgtgccctctccctcctcagttttgacgtactccgctgaatctgatccatccccacccaccctccgccctcctctccgacttcatgcttggctggaccaactgtttcgctgtcgaccttgaagtcccccaccttatcttttactcctccggtgccttcgtcgtctccgtcatcaaccacatctggctccgcatgccctgccacgaggatggcgacaaccccaacaccctcaccgtcctttccgacctccccttttctcggtcttccccttcaaccaccttcccaacctctagcgccggttcagggccagtgacccgaactgaaagtttgtatgggagggcttcctcgccaacgctgctagtagctagggggtggccatcaacaccatcgacgcccacgagggccccttccttgcccacctaaagcgggcctatcatcgcatctaggcggtggggcccatctcctcattcggtcccatgactgagagaggtggccggagctctatctcggtggaggaggtggcggcttggcttgacgcgtgcccgccgcgatcggtggtgtacgtctgcttcgggagccagtacacactgacggagaagcaggggtgggccttggcggtggtgctggagcgcagcggggcacgttttgtgtggaccaccagttgtggtggggtgttggtgccgaagggctttgaggggcgggtggtgggacgggggctagttgttagatccggactggccctagaaaaaaaaaaatgggctggtccgatcctaacccacaatccatgtgggctagggccgggttaaatttttacagcaccttttaataagtgggccaagcctggtcaggcccacataatcacagcccacgtgggttagagccgggtttacaaaatatgcagtaagagttaataaatatttccatcatgtacattgtgttatggtttattagtttattcaatataataaattccacgacttcaacttctgcacctgtatcttccttttgatggaaagtataaatacttcaatacggtgtctatatgggaagaatgataatctgagacaaagttccttggaacaaataggatgggggtataggagatgtttctccatccttccacatcaaaatgatcaaaatcaataggcatctaaaagaacataatgatatcaaagccaatttgcatcaagcaattggtggctgattgtttatcctcctttcggcccaaccggaatttaagcacatagtttcaaacttcgtatattctttgctgcttctaattcccccttttcagggcaatgggctgaaaattatgagctgacttcgaactcgtgtggcacttggattaaccaaacagtactcgaagcttgtgctagccttggttgttttgagaacgagatgagaatgccccttcctcgttcttttttttcttcttcaaaaagtataatgggatgccaccaccgggtaggaaacattggacctcatcttcaaactgggagggatgctgctcggtgaagttaaggctggctggcaattcctccatatctttagttttcagccaaacattgccaaaagtccaagtctggtaaccaaggatgcttcgctcctggttcttgtttaccttcaatgtaagaattgctggggtatcaaccaagttaaaagggtttgatgacccaccatatggtgacaacagagagcttaaggtttaaggtcaagcaaacaatgtcaatttgcatcaaaaaaacaaaagaaaaaaagaggaacaagatggactaatggtagaagaaatagaaagacaacttgtgtagtagaaatggattggaatgggcttaatagttcgtgactagaattggaattggtacgaatccgaatgattatattctcaggcacgtttgattcatgactagaatcagaattagaatagaagtggtatttaaatactaagtgagagcctagattaaattttagaggattgaagcataatttccattaaatagaactcctctccaccaaacaactagaattggagccatttattttcattctccttctacagcccaactcacatcaatcaaatatatcctgagctatgatgagttttttctgctctgttttctttttttgtacatcttgtccaaaatttaggtgcaaaataaaattgagtgtaaacaagacttttttgatcatttatctacgcagaacattgacctcccgtagtttctcaaaaaatagaagaaaaaccttcatgagttagaaagttggattactaaaccagcaatatatatttgaaacaaccatgggttaatatttgaatttaggcagttaacctgtcattggtcctctctctctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaatcaagggttggattttggccagaaggcaaacggcgacaagccaataataaagcgaaaggagttggaaatgatagagcaaagaaaaatgttaaagaaatgaaaaatttttatgataaaagggtgaacgagcaacctgaggccaactttaaataattcttcatataggccgattctatctggtggaggatcaccgatcctgtagctaggccttggggactctaactcaaacgagactgggatcccgtattaggcctatattagatttagatctcctgaatccagcatggatctgatggtgtcaggcacaaaagatggttcaccctcatgcccaacatcagaaccagtagggtcttcccccaaagcaagagaaagctcagaagaccaaccctcaccaaaaccatcagagctaacattagagaacaaaaggaggaagaagagaaggagaagggccaagaaaagtaatagggaatgaaaaaagagaaaaaaaaaggaactaaaaatcagtaggagaatgaagaaatccacctacgatggtgcgggagatgaggatcgattaatcaacggaagtcaccgaaagaagtcgtcagtaactcaaagaaaccaggggagatagccagaaggggaatgcctctaaaagcttgaagaaagtcagaaacttgatcagaaagaaaaggaggactctgaaagcataagaaaagtcagaaaagaaatgcagcccttttttataagcacagaaagaatggtacagtttggatatcaaatcttccctgaccgttggataggtgacgtctggtgtacccctattggcccacagaaatcaatagttggcttatttatgagtaacactcagaatgaagcacgccattccttgaaccctgcaaatctatcctacctttcttgatcatgattaatctctgacgtgactctttctttcttcgaaaaggcacaagcacgtcatagtcgtaatagaggcgtgtcttctgcaatcgctcactagcatactccctacgtccgagccctactcgatttgaacttgggagtaaggaggtatgtgttgggggggataatacattgtcacgctgaagatgcatggcaacggagatcttagtttgatttagtttgatttggtccaatcctgcactcaagatcgccaccacagtatcgatcagtggtgaatgagtataatcttagtggtagatatattacctcagaactgtgaaggaagctacgttaaaagaagtcattcaatacataatgaagcagcaggcctcactctggatcctgtcgatctccatcctcttactgatcctatcggatgaagctcctataatgggtggaggaaggcccggccaatcccaacttcgaacaccaaccccaacttcggctactggatttggttttggttgtctctcatgacattgcccatgggtccctagccactggcactagggtaacgctcgaacatcagacgcagatccaaaaaaagacttgagcccgatgtcgtcttcgaccaaggatcctacactgatctccatttttagccgcaagctactctttcctcactacttactggctaccgcatttgggagagtcaactcccatcacatcatgttgcatcaccccacatggggccatacatctccaatggctagctatgcgccagatgaagccacgtcaaatcaagccatcttgtgagtggctgactgtgcatcggataagatgacgtccgccaccaaggtccaaatagggaggaatggttacctagatcacacccaagtaaactacttaagtcctaggcgaataacacaccacgacaacacttatatttcataaatccggacatcctgggtggtatggataaagaggtcgaaatgatctcccatctttttttcttattatggcactcgtctccctataaatagagataaaaagagactctccagctatgtatattcgtgcaccctctacccctctcgctcttcttctcctttgttgtatttttttgacttgggcgtcggagtatttctctcagaatcaacttcgatcggaacttattttgtagatcacactgcttcggtcatctccagtcaccctgaccaaagtcagaaatatcccgcaacagcttttaaatttatattggtattcatattcaagcaattcaccatatagtaaataaactaaggaaatgatatgcatatatatggaacaaccattagtttccatggtgtcaattttttatcaactttcaaatcattataatattgtcctaaaatttagttaagttgactattatgctgccagaatgcttctataaattataactgtgttgatagacagacactattaacataatttcttggaaatagaaaagcacctcctaaatcattcaattgaacccaatcctaccacttatttaagtcaatgtcatatggtttgatattattttcaaatttatcaagaggatgtctagtgtttatgagtactttaaaaaaaaagtgctactacaaatatgctgccaaagtgatgcaatttaagattttttgaaagttaaaaaaatgaatatgatactcccatttttagataatttgttaatattcaaaaattcttaattagccaaccaagtcatacacattaagccataaaatcctaaatatttcaaacaataacatgttagaatgaaaagatatcatagttagtttatatagtattagctaggcatatcaatgaattatcataggacaacatgattatataaaaataaaaggatattgataaacatttcgaacaaatacaatcaatatgagtacaaatgatttcgtaatgttgaatgggaatcctaaaatatactaataatttaatatattacatgcaatttgattttcttaacttggaattttttatgttagcaaaagcaacaaattttttctctcgaacttgttgctatcctaaaaataatattttttttgcaaataattttgaaagatctctcacagtatattttttttgaactccctatcgattaatgatataagaagaaagaattgtaatgataattaaataatttaaaaataatactattattgattggtatcattggtttgtacaatttttaattgatttataaataatagttttttattgattgtactatcttatatatataacatatatatataatatatatatataacatatatatatatatatatatatatatatatatataatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatccctatttaaatcccgtcccttcttccgctaggttcgatctaatcgatcttcccgaggctccccttccctagatttaatcgaggtgaggggaataagagggcggatttgattggcttcgattcttcttcaggtcattctcgtgttcgatctcgatccctagggtattcctttttctctctcttctgcccccctttgatcctcttgtgtgcttgcaaatctctatcaaaattcgatctttattctcttttttggattcggagctgtggctgctgactagatttgagggatttaggctttccacggttgtgtgattcttggctgattcctgtgatttgagggctcttggttccgttatcttcggagccaaagaagcgattttgaccacctatattacttcttccatcaacttggagctgttgtcgatcggtattttgctatcgataacgagtgattgcgagcaacttgaagacgatataagaggaggaatccagtgtttgtggtggcagatgaagccggtattgaagagcaaaatggccgacgaggagggagattacttccccccgacaccaaggaagggctggtcgatcggtctgatgaagttcgtctcccttctggttgttttcatggcaggggcggtgctgggcctgtcggtgagcgcccatttccacaagtacttcagctcccaggccgatctcttctttccgaggaccctgtacacggcgacttgcgacagggattgcatgagcatcaagagcttcgtgaatccgtcccatttgatgcacgccatgaccgacgacaagctcttctggcgggcgacgatggtgcccaagatggaggattaccccttcgagagggtccccaaggtggctttcatgttcctcacacgggggcctctgccgtttgtgcggctgtgggataagttcttcaaaggccatgagggcttgtattccgtctatgtgcatgcgcttcctgactacaagctcaatgtctcggaggattctgctttctatggccgccaaatccccagcttggtaagacattaatttggtctatgtttattttttttattcaagtgtgatctatgaagatagacttcttggacttctcattaagtttaatttcactagttgcaagaacttgggtaattcatgtatttccgatctttatggatcatatagtgactactaaataagcaaaaacagaaagcattgaatgtccaagaactatatcattggttctgttcttttaaacttcaaacagatcgatagtattttttttttttaatattagattaatttatatccaacatttagtagagttacttagaatgtaatttggggcattgtaatacaatttacatctatggagccaagaaaattgattgctgtcatgaatgatgtttccgagaaggttattttaaacattcagattcccctggattagaaggtttcaagcaggcaagtaactagcatttttagaatgtaatcaaatgtctcttgcaatgcaagtattaacaaaatgcatttcaaaatctaaatatgatccgcagcgtataccaacaatggttgcagacaggccttaatcttcatataatagttaatgtgaaatttctgaaaaatttaccggacatcctctctataacagttggcacaatgttgtaagacaccataaaagaaatcagaaagatattgtaaaacaattataactacataaaagaaaatgacaacttggtaagataatgatgcaaatcattatttacattatttctagaagtatttgttgatttcagaccatttggaatgaatgattgttgcttttttctttttgcatctaacttgcatcattcttctgtgttcctatgcaggaagtttcatggggttcggttactctggtagatgcagagaagcgtctcttggccaatgctctcttggatttctccaatgagcggtttgttttgctctcggagagttgcataccaatatacaatttccctgctgtttatgagtacctcataaactcacaccacagctttgttgagtcctatgatgaggattcgctgcagggccgtggccgttacagacgtggcatgtcccctcatatcaaactctatcaatggagaaaaggttctgagtggttcgagctcaaccgtgaattggctgtgactatagttgcagactacaagtactatgccatcttcaggaaatactgtaagccttcttgctatcctgatgagcactacatcccaacttacctgaatatgttccatggatctctgaatgcgaaccggagcttgacatgggttgattggtcaaggggaggccctcacccagcgagatatggtgcttcaaatgttacaccggagtttattcaggcattaagaaataatgggaccttctgtatgtacaattcgaggccgacttctatttgtttcctctttgcaaggaagtttgctccaaatgcattggaacctctactcaacctcacttcaacagtaatgggtttctgactgactttgtttggcatgctgatttattgccttcaggagatactccattcacttctcagtgatcagggaggaattattctgacactaccaccagggcatccttgctgcctctggattttgactagaggcgagtctcggattattttttctgatggacggtgtagcagattatgtggtaggcagtccagaagttgcttaatggaggatgtgaaggtgccagacacggagcttcaatttcttattccatatcctcagttaattttggtttggtacaagagatattgtaatgcatttgttcagatactcatctgtaaatatgaattcatcattcgttttgtcattttaagttcaacaatgccattgggtttttatctcctcgatgttggtagcagcttaaatatttcttttcatgccttgaaagtggttggcagtgtttggtgtatattccaactcttggatgatgattgaagagagaggaatacaaagtgaaacgtgcttgcacctaacaaaactcatggatagattttttttttgccaaatatagtttatttattaggttttcaattttcatctaacatgtacatgttgattatggtttatttaatctgaaaacatgttctatggtttctatgtcaggttttattagtgtaagagaaaagggattttcaattaggaatcgaataattttaatatatatatatatatattcagggatctgtgaacagtgcataacagcaatgttggtgagacaaggatgcactattttcaacttgatcgatagatgaagtctttgtttagtttctgaacataagtctttgtttaggttctgaacatagatcactagatggcatggaattatatgtctgtttctctaaacaattatatcagtttagtatatagttatacaaaacaacaaaataaacataaaatggcgacaaaattgatgaagaggtgggaagaaattttctctcagcagggatttaataaaatatggcagtcaatctaagggatgaactccaagtaaccaggtcaagtcaacacaaggtccatcatgaccaaactcatctgcatggcttagtctaacttgtccaccttcaaactacaccagccatttggctacatatcatccatttaggtagatcacaatatattattcaaatttttaatatatataaaaaaaaaggaacagttcatcacatttcattccatttatttatggtggtcagtcttgacccaaagactacaaagagatgaatatttgctgaaatgaactgcttttctctagtggaacgtacggaatgggaggataagaaacttgtatgcaactagttgatcaagcttgtgacctagcgtggaacttcctggacatcaactcagaatgccagttggaagggttaatgcttctaataagcctttaaggaatatatatatatatatatatatatatatatatatatatatatatatatatatatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatacgaagattctttctccactttctctctctactttctttctcatgaccgtacttttttatttaagaaggtctatgaatcctgtactgagtcatgccttcatcttttaggggctcatattgactctaacaagatgatccgaagttgctttaatatccatgctgtatgtcaacctcatttgatcatatcaaatatctttcaaattcatgattaatgaactctattgattgatcttgatttaatctgtgcttcataatttcttaatcaagtcacttaaatctgaccctcagatcagagaccctgaattgctccggtatctggatggtccgacacatgcagacaacagtcatctttccttatgatttaatcttattatattcataaaatagaaattaatgatgatttgatattttaaataagattagttgattcttctaacgaagtctgaagatctaaaatgaacgaggtaagtggatcttacgttctttatttatttttaaataatcatatttttcatgcaaagaactattgttgatgaaatcatattttttataaaataaggatcagcacgtgtgatatgaaaaattatattttattatgagcattgattttatgaatatattttataaaaatagcatgattatgaagcatgaattttattatttttttatttatgtatatgtatgctttaaaaaaaagatataaagatttcaaaggctctcagatagctatgaacgaatctcttcggaaaggtcgacatccagagctagcatccacacgaaacatagccctgccaacgggtataaagttggcatatgaattaagaactctgtcgattaagaaatatggccctatcacaggtataatagtgatcttagaacgaatatctgggagcaatatatcaaaacttgacatgaatacatgataagaatgatttatgattcatgattgtgaaatatacatgattttatgcatgcatgattggtttataatttattttattatatgttctatgaaatattttattttatattatctgttattttttaaatattacattatcatgaaaaatttatgcttgattcgataaagaagtgtaagttttacttactagactagtgtagccatattctttttttgtttgaacagaggaataaggttaagaccggcaaaagaaattcagatttagagatctgcgatgcaagcttggaaattttgtagatgaggtttagataaatgatgatcatgaacttatagtaagtaattatggattttgatatatgaatttatatttgattttggatttagatgctctaaatcaatattgatttaattatctgataaataaagaaattgaatcttttatttgatggattttggatgattatgttggattggcttcgtgttatcatgggctccatccttcggtagcatggtcgtgttatgtcccgaatttgaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattatgatataagtgattaggatattatagaataacatcagagcttaggtgtaagatcactgagattatgaagtgatatcaaaactttatgtatgatcaataggatatgacagagtaaagtatgatagataatatcagagcttaagattatgatcattaaggacgtgatagaatgatataaaatttaggttatgatcattagagaatatgacttaagtggtatttgagcttaaggttatcattattcaagatcgtgactttagtgatatttgaacttaaggctaagatcataaggaatatgatagatataaaagaaaggattcaataatttgatttcaaaccaataggtattatgatgaaatttatgcataagcagcatatgatgtctataatagaattgacaagttatatcttggatttcaattagtagggttgatctgagtacgagaagtgttaactctggaatgaagtgggaggtattgatatgttatgttgggtatatttgatgacattagaatgctaaacttatatggataaaggacatgataactttgctgattttgatgttaatttttttgcaaaaaaagataggttaggaagttgtttaaatgattgtaagataaatcaaaggttaactcaaattaattctagacatattggattcttgaggagtggtgaaacttatacaataagttcaaatatagaagatggatgaagatttaattttgatgtgctatgcctaagagatgtaatgacaagaaaactataaattttatcctaaattttatatgaaatctgaaagttggatctatctttgattgatttaacatataaagatatttttatttttgatagatttagataatttggtaagttgagatcagagtgcgcagcaaaagcatgatggtctgaattaattaaaaatattaatcttttaaattaaaagatattatgaaatacgttagttataaataaggaaggattttactgataataaaagaatgctagagagaaaatctatctgatcaaggaaagacttaaggcagcacaggacagacaaaagagttgggcagataaaaaaagaagagaattagaatttcagatcggtgatcatatttttctaaaagtatcacctacaaaaagtgtcatgagatttgggagacatggcaagctgagtcaacgatatattagaccttttgaaattttaagccgagtaggagatgttgctttcgtacttcacttaccattggatttatctaaagtgcacaatgtctttcatgtttcatcactgagaaaatttatacctgatccaaataatgtggtaaagtatgagccattgcaagttcataaagacttaacttatgaagagttttttctctgaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttaacatacatttaatgcctgcagtttcatttttttcatttaaaattttaaataaaaaaatatctttcttattctgaaaaaattatgacatcctgtgatgatattattatattctatggtctaattatgactttctggatacaagatgtcataaataaaagaaaaagatattttcatcatttaaaaattttataaatttttaatgatgaaaatattcttttctctttatgacttttgaaagaaaaattaagacattctgcatgtaaaaagtcataatttgatcacaggacgttataatatagctataagatgtcataatttttttagaagagaagaaatatttttgtcatctaaaatttaaaaaaaaaaatgaaactgcacgcattggaaagtaatgactacatgctctaatgtgattagatggtgtgctccatattaattttatcataccgcatgcggtcgcaaagaattagaaatgaagttcaaaccgctcagtagctgctatctcttccacgtgaatggagggctatgttatcatatagcatagcggcttccagcgccggagaatgtaaaaatactcggaaggctatgttatcttaacaaaccacttacggtagatatcctcatcaagataggaatggcaggcccaacttattgtcttccgtgttcaacccatcatgaaaccatagatcatctcatgactccatgtgaatactcctatctcacataaaaacatctgctacaactctcttcctcctccaaacttcacattatctttgactattggcacaattgtaggttgactgtctccaatcttcacataacagttgcatacaactctgcatttactactggctattggtgcatatggaaagagaggaaaaaccaaattttcaggtttgaagtctaggcttggcagtgtgtgttcaaccaaaaaccctgttgcgagattggtctttgtcatccagctatgtaaaggtcattgcttttgcctctcagcttcatctccgacagaaatttcatggctatagtctttgctccataactttgaaacctttgaagtcagataaactgagctgagctccatgttcatattttctcaaaagtgagattctcggtttaccttattgctttcttcgtagtcacatcataatctccactgattatgtgtttgattttgttggcttttgctaacatgtgggatactatccacatgggactcaccaaaagctatgtgttttggggttataatatgctcatgaatacatgctattgtaaagttaccttattaatgaaataagggtggcacacagcctcccattttacatactgaatatatatataggatggcccttccgttaaccgccatttcttctctcccacaacatctcccaacttttgtctccatttcttcaccttcagcctcaaaatgagaaacaaaagaaagaaagaaggacgagcttttccgatcatctgatcaagaaaaattgatgaaccactcttgaatcgaggttagtcctcttctattctttccattaattagagtttgtgttttgcttcaatttctttgatgcttggtgacaatggtaatttctttattgaggataatttctgattttcacacattgatttcattgatcttcaatagaatatttgtagattataataccagcaattacagtaattacaaaaaaaagaacatcttgattacatactcagtaaggccaaagaaccaaaagtagaattgctaaataaagagaaataaaaaataggtgtgtaggctaaatatgaatatatattgacttactaaacataaagaaaaaacaaataaaagtgtatgtcaaaagtagagtgatgaggtggaatgaatatgtgctgacacaccccctcaagatgaagaatcaggactacgaatcttcaacttgtcccttaggaacctaaaacgtgggtacccaaaggcttggtgagaatatcggcaagctgatcttggatggagatgaactgaacagatagttgatgtcatgcaatacgctcacgaacgaaatgaaaatcaatttcgacatgcttcatgcgagcatggaagacaggactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatttgggattataaattcggtagagggtattttgagattcttgatatggtgtctgctcaatttttattttttttatttttttggttttagtgctagttttcgatatctcaagggtcaagtctttttttttctgcattgaatggatgagattacttcgattttgtttaaaaattctatcggagactgaaatattatccaaatatatatatttttttaattttaccatttgcttgatgatcaaatttaaattcggataataaatatgatcataatattaaatgatggagaagataaatttttcttctgattaaggtttaaacttaatttaataccccctcgtgacagcctctaggctctttcctcaatttcttaacttattgttttttattcttctttaccttcttttaatatattttgatgtaaaattatttttatttgtcatgtcgctatatcatgtggtattttgtttctgctacgggcgtatgagacaaggacgggggaatggatgggtcccttcgctgtgagggctccaagccttccgtctccactacagtgtgtagtctgaactagtgaatacgttgttgtttgttaagtcccaatcacattgatacaacaatctttggagtttgagaaattggatgatgataataacagcgttcaaataatggtccctacaatggagtctacctcttgtagcaccaaccatgagaaaccatgaacagtagactctcctgtacatttgtagaccattatataggcagagattttatgagaaatttattgttaattattttatatcagaaaagagaagtaaatttagcttttggttggactacctagagaaataagcttgaatgtaatgtaggttggattgtttgttgtgcgaatgaccaactaatcaatcataatgacaaagctcatatcatatctactcttaaaggataaagcttccaccatttgcccttcgaaaaaaaaggataaagcttttactcatcatatttcagagaaaaaagaatgaattaacatgaaaactaggtccctccgaaaccctgaaaatcaacattagctcctatttaggagtgaggggccacaggcattgctcaaggcttcttttaagaaacggccaggatttgaatcctagccatagtagagatatcaaccaactaatctaataattattatcttgcttgtggcttccttgcgactaacaatatttgatatattacaattacagcatccataaactgcatgatatattaattatttcatttggacccaacctcttactttctaaaaaacaacaaactcatgtcacaatatcatggattgcaaccatatctttttcatgccaccttgccatgcgctcatcaattaagcatgccaatatcatcttagctaccaatttaattattaaacgaaccttgtcattgccgatcgagcagcacaacatcccaacttagaatttcagaaaaaataatcttagagatataagaaaagaatagttctatgacaatgattcttgctgcttagtttctccggttggcagaaagtatgcatggtatctttcatacatgctagagctatgcaaccaatgcttggtaagcacttgctgaatactttaattggcaaatgtctcctcccatataagattgtctgcccatggaggcctggaagaaaaacacatggcccctcgtcccaatcatcgattagtcttgtatgttgtatatcttgtagtgaaatgctttagatcggtattgcgacaaaggtgcctgatggagaaggatgtcaaagcacagaattctttaaaacattgatcaaatcaaagagagatagaagtcaactagctagccttgtttctattggttggcatctcccttcctaaagcttggtcatcaagatcaaggaccccttatatcgtagatacagtacccataagatatttgtatctgtccaagatccccatggcttgcatcggctttcgcataaattgtactcaaaaattgaaaaattatatcatgcactgtacataccatgtagcagtgcaccacaccaatcatatgctgcaattcttatgggatacatacatcatgcgtcatcttagactgccgtttgcacacctcatctcgatttattcctgcaatatactgctgatatggtgcttggtgcagaatataatttctccaaagaaaatgtgggagttaaaatgtacatggcctccaccaacatctgacacctctctctctctctctctccttcacatacaatggtagtatctctctctctctctctctctgagaagttcctctgatgttgtgtctcgctcgctcgtccaagtttaccacctgtttaaagagtttccatgcaatgttagtatctgccgggccatcaaacttcagcaccaaaaatctcggcctctaaaagatattgcccagttgcaaatagcgttagcggttggtaacacgttgacacaaagattgctcgtaagcgattagaagccaacgcaatccaccatatttctccattgccatttgccatttgcccacgtgatccttcctttattacgcggcagtaagcgtgacacaattcttcaccttcattggtcccaccgtaagatcccgattacatacggcaattgagttggattggatcaaattcagataagattaaaaaatcatccatccaaatcgaatctattcattaaacagatcaaaaattcagatatgaactcgatttatttattaaacaaataattcgatctgacttacttaatctatttattaaataaattaaattagattaaatagattaaacatgttacatagatcggattaaataggtcgaaaatagattaagcaaattttaaatagattaaatagattttaaatacgttaaatagattaaatggattaaacaagttatttaactcaatccaatctaaatattaaacgagttaaatgatttatatatctaaaactgaaattcgatccaaatattaaatagattaaatggatcgatctattcatgatccaaatctgtttagtctaaattcaaatctatttgtaacggatcgaacatgagtcagattaatagatcaagttatattttattggaccctaattttgatgcatggaacatttagtgtgacgtcaaatagtgcaccaagcttgatttaaaaaaataaataaatgcacttataagaaagaggcagagagagtgtgtgtgtctgagggatggcagtttggttcgatccgttggatatctgatctgatctgattcgaatgaggcagattttaccgaacccgattgaaatccgaggtagatatgggttttaaaaaaaaaatccaaagcggatataggttgggtatgggtaatagtatgccccaccctgaatccgatccgatatatatatacacacacactcaaatactcaatacaaaatcctagccatctaagcttcctgtatttggccactctgtctcctctaagcttccatatttggccactccaagccttccacccaattgggactcttgaggttgggaaaagcaggaaaaaaattaggagaagatgaaagaaaaataaaaaataaataaagaaaaaatgaaaaaatttgagaggtaagtcctttttctatatatattatttttttttattttttcttttcttttcattattttttcagagatctgcaggaaaggagagcacttgaaagagattaaaggggtttttgaagttccgattgaatttttttgcctcaagtatatgggattctatctgagctgtagcagtgtgagttggttccttgaggttttgaaagcttaatcttggtagaagcataatattttgtagaattagagttttttgattgaaaagaatttttttttggctacaagatttttaatttatagggctttgcttcgttacataatttttttaaaaaaattatataaaaatttcggatatatccaatccgatccgatctgacccaattcattcttgaagctcgacccggtccaactcgaatcgagatgggtaaggagcgggtatggatatggaattttggctagtaaggcagttatggatattgatcaatccgatccatatatgcccgttgtcacccttgtttatttatggataggtttcttaattcaaaatattcaaagataagtatggtaagtaatgattcggatataattgagtttcttaattcaaaatattcaaagataaatatgataagtcacaatttgaatataattgcatcgttataaattatttacctcatataagcaacaggaccgaaaaaaaaaaaaaagttacgttttgtgtacgggtagaagaaaagggaagttaaaagagaatggagggaggagaggagaaggacatggcgagcagcaagggaggggcgatggcattgccggcgagagaagaaggtgatgggggacatggaggagcaggaggggagaaggaggacatggagatggggatgagagagccgtttctgagaaggcgcaccatgaacaccgcctcccagctcgccgtcgtcggcgcccacgtcagccccattgagagcttggactacgagtaagccatcgatgacgatccctttccctcctatgaatcatgtctttgtgtttgtcgatgaatatgaaacatgagaacccacggtcttatgaattattatgcattgccgcattactccgaacgatctttagcagttattttttcgatataatctcaatgctacagactctttagtttatgtccaatgctattgagcctagtaaattatcgaagttatctataatgatgtgggatgacaacatgactattgtgtttatatctgattcttttgcatgatgatactcccatgcaattgcaagagaagcatctaaccaattctgtatatgctttcttcttgtcccgttattatgaatttattattgttatcgatagctagttactctgttattgatggattgtagtggctgatgttccttacttttggttcctgatcatcaggaacctatagaatcctgttttaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacctcccacttaacagtgcaatttattagttggattcttggcatgaccaccttgtagaaacacaatcatatgccaatactactgccgctggttaaagtctattggaatatccactaagcatgattgggcactgtgtactgtggaacccaaatgaacgcaaatatttgttatcatttgattagttgaaaaagtatgagcatctcaggaatttgaagaagctgatcttttgctcatctcaaacattagaagtaagaagtcataaacactttctcaactgtaaggattaatgtgttgcatacacataaacatatgaatgaatgtcataaactatccacaaactaatgttccataatttgattagtcttttcttttttctctctcttttgataaaaaataataatggggcacaaccaataacttcaaagacaatattggtgaattacgcaggtcaattactgtacataacttggcagtcaaacaacagattgtaatcatttaacattgtaaaggcaaaagacaagttataataattgaaagcttccaaatgcacgtaatcttatccattgtaatggaattgaaatttactgcttgataaatagcattcacatctgtacaataagtccaattaaatactatgtgatctcaatgcaggcaccgtgaagcatttttggcatatgctggttgtaatttaatattagctgcagcagctgcagccttatgtgcttacattgctccagcggctgctggatctggcatacctgaagtgaaagcttatcttaatggtatcgatgctcactctatattggctcccagcacactgtttgtgaaggttattccagtccttaccttttatttgtcttatgtttctcatgccaccatcaatgcagaaatatgatacaaataaggatacgagttaaatgcaatgcacataagcatccaatatctgtttttatctttatacagtacataagaaaagaaatttataacacagaattagcatgcaaatcttcctgtccgtcagatctccttaacactagttagtgatcattcacaaaataagttgtttatgtgacctctcagtacttttagaggtccatttcatcattagcacatatggccagttcaccaaagaggtcatggtcatcataattgggacctggcagtggtcagatttgaacttcacttggtcacctgcccaacctaatcgacaaaagaatatgttgggttaccaattgcttccttacaattttcctgccttctcagtttaacccatctccaccatgcttagttgtcttccttctgtaatgaccacacatgaagcactccagaccatcaataacctttttgtctgtcccagaacctccatgttgacagaggcctcataataaattctacaatatgctcaaaacagtagttacatctgctcttcctatcatggaccgaaaaattgtcagcataaagacatattaaggatttaatactcttaactgttattgctactttcatcatatggacatctaggtcagtttatatttaatttgcatgaaattataagcacaatctcgtttatttagcaagctattcaaacttgtccttatactttgaatatatttattatttgcaacttggccaaggatcagaaagattttcaaactttgtagtacctcaagtcatttagtttctccatgtcatcacacactaggattttgggtctggtaataatctaaaaagcttattttcttttaaggatcctcatggctggctgttgtctgctggcattatcctaccttcaaaggctttaattttggagtgtatttgatgcactgatctacagatatttggttccatttgtggagtctctgctggatttgtgttgggtaaggaggggcctatggtgcacacaggagcatgtattgcaaattttcttggtcagggtggatctcgcaagtatcatctgacatggacatggctcagattcttcaaaaatgatagggatcgacgagacttgatcacttgtggggctgctgcaggtgtggcaactgccttccgagcacctgtcggtggggtcctatttgcccttgaagaggcagcctcttggtatcatcctaatgcttttattttttatttttattctcatattcttctttcatatctttgcattcagttgaactctggttcttcaagggaaaaaaaaatcatattttttaggagttttttatcaccaaacagaaaaagatggttcaagaaaatcccagcaaatacagtttttctgaaacaatcataagatacagaaggcgtctattataaactcaaaataatgatcctatgacattgttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccgaaaagaggaggaaatggctcgaccgaacagggtagaacagggtctcgccttttcatcaatttttccaacgatcccgacggccgacgagggtgcacgaagccatgggaaggaggggaaggaggagaggaaggagggccggggcttaccttcgacttcggtgaggtttccggcgagaaattgaggtgaacacaaaaacagggtcgagagcttcaacggagaattccagaagaagaaagagggagatctcacggctggtcgaggctggcttttgagggggagaaggggatttatagggctcttttcaggggttttcgatggccccggggagttcttctcctgatcggtcttagggaagaagaagactcccgttgggagtcttcatccttctttttttttttttttgatgggctttgtgggctttttggcccaacaggccggattatcacagttacatagttacatacatgcagcgcttataagtacgtccaatgcaatggatggatagatgacagagaatgattcatttcatctgtttttaaggagaaaatgatacatttcatattgaactagcttctagctataatgcacctgccaacgcatgtgaatcctgaagaattcagattcgaggaaatttaactgaagtctgaattctaataagatgtgaaaataatgaattagtattttaatgcattttttagaagttaatgctttaaatctctagatatactgagatatcacttttaccagtttttcatttcttttttttgctaaattaaattttctggtttaaaagttagcatgagttggtttgttccttcattctatatctactcatttttttcattctcaaagtccagcaacattataattccttcttttatgaagtctagcatgttttaaacctttcgagaggaaaatttaactagctttacatttgaaatgttttatatctttaacagagtatcctgataaaggtaatttttgaaattggaaaatttggaaatcaagccacttttatacagttttatctttaaatatacatatatatcattgccaactacagtgcaaaattttctacaaatctacttcataagatctaagctataaattggtatttcatagaccctgtactgtttatccacgttggagagagtatctaagcctagttagcagagtgtattataaattttaactgtttttctttgatcatttaggtggcgaagtgctcttctttggagaacatttttcacaacagccgtggttgctgtcacactgagagctttcggggagtactgccggagtggaaaatgcgggctctttggaggaggaggattgataatgtttgatctgagttcaactgctacctcctatagcacaccagatcttattgcagttgtatttgttggagccattgggggtatatttggaagtctatacaactttctcgtggacaaggtcctttgcacatatagcattataaatgagtatgtctcaatactgcttagctggttgttgtcattcttggattgtgttgatatactctagacattagcttaaatcttctctcattgccaaagattttagttgcactccattcttgttctccatgctgtttctgacagggtctaattatttgcaggaaaggtgcacctttcaagatccttctgacagtcaccatctctctcttgacatcatgctgctcctatggactcccttggctagccaaatgcaccccatgtcctcttggtctccatgagcactgtcctaccgttggccgctcaggcaacttcaagaactttcaatgcccacaaggtcattacaatgaccttgcttctctcttcctgaataccagtggtgatgccattcgcattctcttcagcagtggcactgacaatgagttctatatttcgtctctcttcgtttttttcactgccatatatttccttggcattgtaacctatggcattgctgtaccttctggtctcttcatccctgtcatacttgctggtgcctcctatggtcgcctggtaggttctcttcttggcaccatatgtggcctagataagggcctctttgcccttcttggtgctgcttcttttcttggagggactatgaggatgactgtctcagtttgtgttatactccttgagctcaccaatgaccttccaatgctcccgttggtgatgctagttctcctcatctccaaaactgtagcagatggtttcaacagaggggtctatgatcagattatcataatgaagggcttgccttacatggaggcccatgctgaaccttacatgacaaacttggttgctgggaatgtagtctcaggcccactcattaccttttccagcgtcgaacgggtggcaaatataatgcatgcactgaaggtaactggacataatggatttccagtggttgatgagccacccttttcagatgcaccagagttgtgtggccttgttttgaggtctcatttgcttgtgctgctgaaaggcaagacatttactaaggacagggttttaactggtccggcggaggtttatcaaaggttcggtgccttcgactttgccaaagctgggtctgggaaggagttgaagtttgaggacttggccattgatgaagaggagatggaaatgtatgtagatctccacccagttatgaataggtccccatacacagttattgaaacaatgtctctagccaaggctgcagtgctcttcagagagcttggactaagacacctatgtgttgtgccaaaaacaccaggggtaagaattctttcctccttatttctaattctggactttgttgcgcttacattatgccaatacctgatatcagcctaagtgatcatatatttgaatgtgcaagagcaattttcttgatctatgttctgcttatattctcaagtgagatagtaaataaatattttgtgataaagtttttgtaatttctgacctcttaaattctgaagtcaaaatttttcagcattttcttgattatgttaatttatattgtggatggtgatgattgcattctaacttgatcagttcagattttggactttgtccaatctttataaataaataaattaaaaaaaaattgatcagtttagatatgtagaaacgttgaccaacacaaacaaacaatctttacaataaaatataccatgcgagtgtccctgtcttcttacactgtttgactgtgaccaaggttgttcatgggctctagttcataaaccaatcgatatggcaatgggtcgggtttggttggtttcgcatcaagtcaagttaggacaccaacatacaaaaccttagcctatacccaacctcacccaacatctggtgaatacttcttgatgcatacccactcatgggtaatttttggtcacctatttgaccctagcctgatctattttgaaatttgatacctaataactctacactaacctaccaaatccaatatttataattcttaccggttaatttccaaatttaaacaactagtgttgagaaaaagactaattatagaaaagatcttatccaagatcatgactcaaccgaacttaaaatattttgaccaaatagagctctaatccgatgaccgaagtcaggtcaaagttttgacccatgcaggaatagttcaggtcagaaaatctaacccatattttaactaaaaaaatcttgacccaaacccgagccagatgcgaaaagatgtaaaacaaaatgttaatggtgaaaaataaattgagcttgtacaccattgaactcttaataccatgctaatctgccctgtgggaacaattggctttttgggtttggattaagccgaattgatatatacctagcttaaatgctactcattctccttcaagttgtttaggttataatagatataggaattgtagtgctatcttatttttgaagtttttcttgcccaaacatgccttgttaaatgaagtgtcaatgctcttatgaaacctgaaatctgttttcttgcagaggcctcccattattgggattttgacacgacatgacttcatgccagagcacattctaggactgtttcctcaactcaagcatcaaaattaaccatacagcattggtgtgacattcttttccttgatctaattgctattgctgctacacttaaaatttgagttttagcattgttaccatccttaattaccatttttttttctggaaggttggtgaagatctaagcttggagctgcagatttattattagagaaatcaacatcaaatctcaaatgtattccaagctacatttctctttgtaacatgttttgcaatatattgttgatgtgaatttgacattctgctgctccagagctcgaacctgtacagttgatgtgaatttgacattctgacagtagttacatattgggagaacatgatattctctcggagaaattgttttaatagggttgtatatataattgaagaagggaactacatattcaaagattctaaatattttcccatgttagccttgaggatacatgattgggttttgacctacaggtagaacaagaaaacaggtcatctatttagctcaagaactttgttacttttctagccagtcatggccatatcaaaaggaccaacaagccttgtccagtttctccaagtctcttctcacagcttccatagagttttcacagctctctttggaaattgtttcacaaaccaaaccatttaaactagtattttgattgttaagctttttaagcagtttagttatcaggatgctaagatgttgacaagtaatattattactgtcatggtggcagaaaaatattaggatggactcttgatatgctttttttttttttttttggtaagatatgctttttgtttaacaaattttcatggtgctagcaattggagggcattggtgaatagtggacttttgttaaactatctactttgaagactttcagatggaattgtatatagtgctttatgtttttgtttactttggtgccttttacctgattttttggtccctaacttggatgatatttggattttaacaaatctttacatatcaaaacgaaggagaagggggtgattccatcttataagatgcatcagttaatattattattttcttggaaataataaagttttcttttaacacagtcagcattactctagcacaaattaattagctgcatgggaactgaaacttgggtttccctgtgattttagcgtttgttttataattgaagatatatttgaatcaagacttgcaagcaaaaaaaaaacaagaaaatttcttgtcaatatactggttaacagttctatggctaataaatctccagcccggtgattctctaatactgtacaaaaatcttacaggctatttttatttttttttctactgttgactcattgctcaaatccattgaagaatatctaagcagttggtacatagaatagaatgatagataaaggatctcaacaaggcgcaacttcgccagctagaatcagcactttgttggaatgacaaaaaaaaagtgaaggaattttatcaatgaccatgcttgagaaagtattttgttttcattggcctcagcaaaaaggaaaaaagtttcataagagaaagatggcaagcttactgcttcatttcgataagataatcaaatcaggtgtaacaaaattagaattaagcattaaaaaaaaaaaagtctgcctaaacttttggatatctttttcctttttcttcttttaagctatcaaagagccccctccacagagtttgttgaggctttgagaatccagcatcaagcaccttccagattctccaccagatagctgcatgatatttcttgttgtttctgcttattgcctaaactcctcaaaagggcaaaattttgcctgggcaacaaaattgacaaagtgtttttttctttctttttttttttttttttttttttttaaggacaacaaattacaaggtagaactagcaaaaatgactcgacgactgccaaccttctcagctaagaaagcaatgttttttaccgccctaatttgccagaatcaacatattcttttatattacttcccatgccacatgtatctcaagaattgaaaacaaaaattggcgtcaaagtcatgcatttccaggtatttagatccggaacggtggcaggcactgccatccatcaattagaatttacttgatgacaatcaggaggtaagagtcatatagaaaatgactcaaatccaagaaaactaaaagcatatttgattcatgatcgaaattagaatcagaatcgaaatgaaaatcagaatggccgtatcacttaaagcatttggttagaggttagaattgaaatcgaaataaaaatgatatttgaataatagaagaaaataaggattagattttgagagattaagatatttctattttttttgggaatcagaatgataataaattttttctaaccaaatgattgaaatgaaagccacacattcttattcctatttcagctcctttcagagtccaactttttccaaccaaacatgccttataggagcaaggcagagagaaattcagtgactagaactcccccatggaagaagaaagaatctattcctgagagccaaatacagtgaaaaagatactccattccattgaagcctcaccttcacccaagcccttcatctctcctctcaaacacccatatctctcctcccgttttgctgctttcctccaaaagtacaacttcatcatttagtaaattgcagctttgtctagaaacctgatctccagccctggcacatgatgtaatgaaggggtgcaccatgcaagagtgataccaactaattgactattttagagagagtaagcttaagtgagaaagtctcttgactaaaaagatgagggttagggtttcttttactgtggctttctgagggtcatcggagccttttgacccacaatggagcttgatcctaaggggtccaactgaacaagtctctcatgactaatcttcatgaggattcgaaaaggaaggcagagttgtcttcatcgtcttgatattttactacttctactggtccaccatcgactgattctacttattcttgggctcaggtggtgcagagcatcagaagattttgataggatactcccaaggcttccttagaagagcttgtatctcttcaagaaagattcaaagaggtggtcactttactaatgaagaattggatcctatctattctaaatggaaaactactccaatcaataagccctttgattgtagtttatctcttgacttcatttagaaagatctgtgagccaggtggggcttgggggagcacctccaagtcgtgccactcttagatgaagtttacttatttaagtttccttcagaggaagtttgtgatcaaatttttgctcgtggtccctttcctttggccaattaacttatagctctccaagaatgatgatctaattttagaccaggtagaaatactattaatcaagtagccatttggttgtggatgcctgacttgcccataaaattttgagagaaggataaaatcctctacattatctgaatgacaggtggatggttgtttcttaatgatgagacctcttcagcttctcaagctagatttgctagggtttgtatccaattagatttagattgtagcatctatcttggacttatattatgttaaagagaattctatttgctaagagtttgtttataaagagttaccgaatctctgctagccatgtaaccatttcagacatctctatgcttcctgtaaaaatcatgaactggatagctccttgcccaagcctattttgggaacttggatcgatacaacttgactcccaatgacagagccttccactgctactaccagatcatcgtctattggtgttgctctttttgtgtttcaagcttcgactagatcttcttccaataaagcccaaagtactccacaaacttagccatcctcatctaccacttaggtctttaaggaagttcatgtattggaggggtcacggtttgttcctttagctcattgcgtagttgaaatagaacttaaaactatggaggaaatcgactcatccaaattctctgctattccatccttggtgtccaaatccaaaatgaagaggaagagatctcctccaaagactctaaaaaattcaacagatcaaatgatttgattcacccacttaaactaaagtaaagactgcaaaggagggtgctgctactgaagaacctgctttatcacccaaactgctgcttcttttatacatgtttctatgcagtctgtgccatccatggagcaaggatagtgtaatgtcgatcctgatcttacccattctttaactgcttcttctttattttcttctaaggccaataacccaaactctcgtaccattttctttggtcagttacaagttgagttgggcctagaacacaccttgattgagcagtatgtcattacaattgcttctctgaagcttttagtgcccagactcaatctcaaataagctctataggggcgtctgtttccatatcttagtatgaaaatattattatgaaattgtcggaatgctgctaagcaccccttttgtttattatataaaaaatctaatacatatgcattgtctagatatttgttgtatcctagaaatatatttgtctaatgcatctctactaaaaattcaatacatactaggttcttcttggcagctatttatcatgctagttattattctgaggatattctgatcttttggcacaagagtttgggatgtctaagcttttttatttctaatcatcaactgtttgtggtgttattacacctgcttcatatttttattaactatttggtacaatttatactagccagtatgaatggtatttagtgtaggccagtttggcattcagttttggttgttttatcattagctttacctactttgcttgtggaggattttaattgcaatccaagtgctaatgaaaagaaatgaggcagatttttttgtttaaaacaagatatagggagttttgatcttttcttcaacatataagtttgattgatttgggttttcaaagacctatgtttacctggtgtaataatcaactaggatctaatagagtataagaatgccttgatagggctttggctaatgttcaataggttgattcattttctgagctcatggccggtcattttgcttctaatcattgtccttcattgattctgtttctaatacttataattataggcctaaacctttttggtttgagaaattttgactctccgagcacatatttatgatgttattcggcaagcttagcactacacaaggaaccattcttctggtgtgcgactttctattgttctacataacaccaaattaggccttagttgatgaaatcattgtcacttaggtaacttttttcaagttggtgaagtccttaataataagttggagtatcttcagttgaaggaagtctcttatagtggtttgcctcattaagatcataaggatttactgcacacccttaggctttataatcttgacttgaatcaataagaaatcttctggcaacaaaagtctagaatttcgtggcttaaggaagaaaatagtagtactaaattttttcgctactctactatacagaagagaagagctactaaaattactaaattttagtcattagatggatctaaagttgacgacgatgttatgattcatcaatttgtattcacttattttaagcttaaatgaacttagcagattgagccactttttgattggttatgtttggtattacccattttatcttctactcaacatgagcaactagtatgcgcagtcactaacaatgaaattaaggaagttgtcaaacaaataaattatgatcgctttctggacctaatagatttcctcctctctctttttttaaggtttttggcctctaattaaatctgatgttgttcttattgtgaaggatacttcacaatatatatctatgccatggtcttggaaacaaacttttattacttgaatctcaaaaaagaataatcttattttaatttttgatccattaatttgtgtaatacaacttaatcattgcaaatttttttacaaacaaactacttatcatgtcttccttaatccatcctgtgcaaggtgccttttttcctacatataaaattacagaatatgttttgattacccaaaagattatgcattccttgatgcatgcacctgtaactcaaagtttaatggcactcaagattgatatgaaaaaaacttttgatcaagttaattgagtatccctcttttgtgctttacaccattttggctttcaacttggattcataaagtgggtacaactccgtgtcaactttattaataaatgataagctatcttcttggtatcaaactactatgggcttaacacaagggtgtccattatctctttatctatttatttgtattcttatatattatctaatatactctagctaccagtaaaaagttaggcccttagagcatataaatcggctagaaatgatccaactcttgctcatattttttctaatttatattgtgctttgtctgaatagattgttaatgcaaataagtcacacattatttttagtccatccactaatgttgtcacaatacaataaatccaccacctaatgcatatgtctttaaaatatgatacttggttatacctgagtgttccccttttagggattagattgaaataatgtgattttacctatttaatagattagatagaagataaaattgagagctggcaatggaagactctttcatttgcatgaagagcaatcttaatgcaatcgatcttaacttctatccccatgtatacaatgattttccttcatttcccttcctccattctacatatattagagaagtacttttgtgccttcttatagggacactctattgattggcatggtctacacgttcttgctcagagtattgtttgtgcctccaaatcaaaaggtcgttttggtatttattctttatgattaaagtagaagtatatgctggagaaacttgttgctcaacttatcttgcaaccccactttctttgggtttaattggtcagatctaagtatcattttcagggatcttgaggtatgtactctcctcttcaataatgttcctccatttggccagggatttcttcttctgcttgctctattgcatatcaatttcagtgggttttatctgctgatactcaggttcagtttgtatttgacccatagatttctatcccattagttgcatcgcttacttgtcttaatattcaggtcgatatcaggaggttcagcttgttaagtttattacacctgatcactcatgagatatggcaatcctggccactatgtttctagctaacatggtctccttgatactagatattcttatagctgctggatctagacttgattagttatgttggagtgctataggggctactcagtctctttgcataatgtttcagctaccatatcctcttctacctcatcagttgtgcctacattttatactatttggagactttcgatttgtatgaatgtcaagactttttgttggaaaccgatttggttgaagctcccgaccaaagaatatctatttcatactcatactctaccacatctaattacttgttttgatttatatcatgacaggaaggaggatttacagtatatttttctcagttgcaagctttcactcctttgttggacacatgtagtccaagtaatgcaatgtagccctcaactccaatctttgctggtattaatctcaaagttgattgttgttttggcagagagatgagttggggctataatggctcacaccttgtggttattttggctataatggcaagaatgggattgttggtaaattctataactcaaattcttcaatatggagaattaaaaggcctagagctagcaatcaagatgctttgtaggaatttgacaacttacatcggatacttgctcaagtttcacctcttcaatgtagagatgaagtggcatggaagttggaatcaaaaggatccttcactactactttatataacttcattaatactagagggatcaaatataagtttgctaactctctttgggacctttgtgtgcctctcaaattaagttaaatgttttctttggctttactggaagaaaaaaattaaatacccaagaacttcttcggaagaagactggaaaaaatctaggtggttgtgtgctttgtggccatggagaagagtcagttgatcatttattctcaacttgttttttcttctcatccatctagaaagctgtttgttccttacttgggatactacaccgacagtcttcctttgaggatcaatgtctttcatggagaagaaggaccttctcaaaatatttacaaccaattattttgatgctatactctgccttcatttgggtcactggaatgaaaggaatcaaagaatttttctcaacaaaagttcatcgatccactccactgctatgaaaggactcaccttgttcaacgaatggtctatcctatataatcataagctactacctccttttggaaagatttgggacaaggttcgacatcttccaaggatgcttgctgatgactgatatggtgaacaatgcaaacaaatgagatatttatgtcccagtacccatcaacgactgttgaaacatgaaggggcaaatggatatgacattaccacttatgcagatgggttctctaacccaccttaatcagcatttttttttttgatagaagagaaggtattactacccattattattaataattagagtagttggttgaccaaggtcaaccagaaaaggacatagttttaggctggcggttttacaggttttgcagatttttagattttctagtgtcgtttacagattttcagatgaaaaattcagaatagccttacaggtttacgtgacttcagtaaactaaaaacagtttgcagctatccaaaaagcgaaccaaatgggatgagaacaacatctttagtttctctattcaatagtttcgatcccaaggcagctagtaaagctgttgaatcattttttgaatactggatttgtgcttatcctcagtgattgcagaccagctagtgagcatttgaataattcttagaatcagggtctttgctgttagagcttcaaacttgaacagccttctattcttttccttgcagatcaactaacagatggttgagacgatggtgtcccaagattgtctatgaattattgttggaagacgatcatgccagcttttccaaatatcttcagccgaagatgaggtatacaaaatacctagcttttgagtgattctctaccaaatggattcagcatagatgcagatggtgaaaagatggcttatggattctggatgtaaacaacacattggacaaacatgagatgtccgaacattccttctttgaagagtttctgtagtaaggattttgttgttttgcagcaaccaagtaaaaattttaattttttcagaataggtgggtactagattttctttgcaaagatagacctgatactgccgtcactgaagaattgataatattttctaacagagaattttctgcttgcactccattttcaattggcattatatgatgtctccaagagagttatactgacaacatttctattgaaactttaaaagatttcctccatgttcaaagatatatcttccctgaaagtcatctcaatattctgaattcttttgaattcatgaacagatagaagttgaatggagaaaagatgaaaaagaattgaaaaattggatttcagtggcataattccaagccattggtcatccaaaatgagatattggttccattgcccagattaaaataaatgctttgatggaagatcatgcctgttttcaccacattttttcaggctatagagacctatttcggagcccttccttttgttctgtttagcagtctgttatgatagtgcggctgtgaatgaggatcttctatgtcgcattgtgtttttggtaaaatctccatcatcatttttgtaacagacacaagttcaagagcttgagatttaagacccccaagcccccaaagagttttggtctgcacacctatctccaattgactacagtgtataccttcgcagtggtcatctcccctccacagaaagctcctgctttttctatcaatgacttcttgaaggattagtaaggaagacatctaatatattggtatcctactgagaacgtgattaataagagttagaggaccccctagagataaaactttacctttccaagcagcaagccttctcttaatcttttcttcaaaaaattttcagtcgcttacagctgatttacggtggataagtggaagtcccaggtaagtagtgggcaatgttgatagcttacaaccaataatttacataataatatcactttctccttctgaagtttccagggtgaagagattattttttttgaaattgatgtttaaccctgatacaagctcaaaggagtagagaataaatttcagagtggaggcatgttgtcgacttgcattgcacaagaggagagtgtcatctgcatattgaatgcacataatttttttttgataatttcatttgttccgatccctgagatgaggttgtttgaggatttcgtgaagtagactgataggtctatagtcacttacttatttgcatttagatttttttgagaccaaggtagcgtaagagtagttcaatctgtgcagatctgttttattactgtatacatctgaaaaaaaaaaaaaatctgatcaggtctaccttgattgtatcccaaaagtgctggtaaaatgatattggaaatccctctggtcctggtgatttatacttggccatactgaaaagggcgtttttaatttctgtttcagagaacggagcttcgaggtcacctaggttctcaagaggttccgggtataatacttcccagttcatgtgataatccggcccaattgggcccaaaaccagcccacaaagcccaccagaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaggaatccaagcttgaagatcggcatagcaagctgaaaaaatttggcaacagaagtttaatttattttataatcatggatttgtagttattcataaatgttgagattcgggttagtacttacttttggatttagatgctctgaacccatattggttcgattatttgataaataatagaattgaatctttttatttgacagatattaggtgattatgataggattggcttcgtgttatcgtgggctccatccctcggtagcatggccgtgttatgtcccagatttggggcgtgacagttcagttcagttgaatgagagatttttcctaagtgccgagtaaacttgaatagtatttcagaaaggtgtctttaatttggtgtagattgccgatgatcctcccttggtcctctatccaagcgatcgtattttttctttttctggcacttactgttatatgaaaaaatttggtatttttgtccgcatattttaaccaatttgctctggatctctgcttccagtgaatctcttcttgatggagaacttgctctgattccaacttaaacttctctctttggctcttctcctcgtttgagagatggttgctgtcctccttgatgtcaagttactgaatttgattcgtgatctcatcttttttttttttttttgatgatgtttccatttgctgatcgattctattattttagtctagctctgagcaacctcaatttgctaaccaggtttgaagctgcattatgatttttgaagctggtgttccaccattgtttcatcatgtcggcaaactcaccttaatcaggtttcttgacaagctgaatactaccaggcaagtgaagctaacaatacccaattcatcctgaggtctaatttgtggaagcaccctcacaaccttgagatcgtgactggccttttcttctctttgtaatctaatttgatgtatcttctggatcatcactcccatcttttctattacttttccgcctttactttgtggatcaacactttgtttatgctgagcaaccttctgtaaataccttagacttcaataaaaaccggatggcagaattctacagcctcccttatcctcaaacaaaaaaaaaaatgaagaaaggctagcagggaatgatcatatctttgaaggtattattacttctcaccagttgctccatgagcattattgttttctccatgatagctcttacacttacgtctctcatgctttgataactatataaacatactgggatagctcagcttttttattttttacatcaccattctttccctctgttagatggcttccccctcactttgcagtagtcaaaataatttttgatagcttagttaagcaaggaactgctacagatgcttatcttgtatgagatcatttgggtgaacctttaaaatgcagccactatcagaataaataaaacttctactcctattgcaggttggtacttgggctagtctcaaaactacaatacattgcttaaaaagggattagattttcttaggaggatattcaaccactatcatttcttggattaactcaccctgactatcaaaatgtgcaggacatccactcttaagtgatattctccaatggaaacagattcttacagtctttactacaactcatattctgcgaaatccaacagattgactagctggccatgcttgtgacttcaatcctttggatcctatttctttggaattgaaaatgcttttataagctgatatagtgggagtcaattattatcggggagattagttatggattattctttatctttgccctttgttttttcttttttttccatagatctttatatctttctaagataaatcatgcagtgcttcttttgatttttagccctaatctcctatgtcagtttgttgcatgttttagctctacgggcttcaccaaatattagtttttttgcaagctgcaccttgtctttcactctatatgccaaagatattgcctttttaatgactatattcatagctttcattatatttcttctactccttgcaatccactctttattgcagatgggctgcgtgttatggaatatatattgcagatggttccttctactatttcggattctgattttcaattgccaatgttcttgcaaagcggcccgacttcaagcttattgtgttcttcgttgctgctatgccactggcctaattgctgatgttctgtgctgctatgatgctatgcatttgttttgtgctgttgttttctgtatccacgtagctgtcatgtttcttgtattgttctaacgacctgcttcccatgctgtgctattacatggtcctaattttacctaatttatgttcgttatactttcagcatatttcagctacagatcttattcatccagttctttatttcagtacttctgctttctatctcatattttagcactccgcattataccaaatcagcttgacaatcgttcgacatttattcttattgcgctgttgagcaacttgtctcatatttatcttgctgcactgttatgtatattatttctctaacatactatgttcccgagtgttttcggattgcttgttttttatttctgtttttaaccttagcttttcttttgtatcaacatgggagtgggagtcctgcaacgcaactaccagaggattttttttttttgggtggtgggggttgggtggaattccgttcctattatttacccaaaaaaaataaaaattaaaaattaaaaaaattataaggaaaaaaaaaagaaaaaagaaaaagaggggtgcacatcttacctcctgtaccatgagatccggcagctgtgattgctcggaatcgtcccggcattgtatcttgctgttgagatttgaacagcccaagcaagccctacagaacatattgtcggttggtcccgcttgccaacgaatgtataggtgacacgcaatccgaggtggccgtgggaatggtggacagctaagcccgagtccatttacccaccaccccattcccctttcttcttcccttgaacgggaaaaaacaaaatacccgcctccattccccgtctccccacctttctctctctctctctctcaaatcgtaaagctagagagggaggggagtttgggagcaggggaacgagggaagatgggggaagcgagagaaggggagggggaggaaattggaaacaaaggtggtggtggtggcggtggtggtggagggggactgggggtggtgagggtgttggtggtggatgactcccccgtggacagaaaggtggtggagatgctgctcaaaaagagtggggaaatgtttgaaggtaagataaggtgttctctgtttcatagtgatctccttttttcttttttcttttttccttaatggttgtttttgttgttgctatggcgtcgcattgaattatttatatgtttaacgctgttattcttgttgcatttttttttaatcgttgaggcaattgtattctttagcgggtgaaataaattggaagttttgattttttgtgtttcattgctatttgtggaattaaatggatggaattcttgtatttccacttctttttgaatgtccattggtgcacaacgatatgtctttcgttgtttgctggttgggtttctaccttccaattattttacaatttttccttctttagttcgttttgtgtttggtttggaatttggactaatttttagcttatctagtgtcatcattctacgtttacatgtatgcactggcactattctcttaaatcataattcatagttgtctctttcggattgtttcattacattttcgctctcggtcttgtggtaatcttatcttctgcaggatgttaaaaacgctgagatgtaaatgagttgaacttatgaaactccattgattaaatgtcatcctaagtcatgttattctataagttggttcatttcatgatacttgatctacctcctttatgattgtatggcctagtccaattattttgactattgtcagagtgcctctgtgatgtctaattgctctctctctctctctctctctctgtatgtgtgtgtgcgcgcgtgcgcgcgcgcatgcaatccatggcccttcccctttttttttaaaaccacaaagtggtatattttgatattggtttagtacacttgtgatctgcttgttatgcagacaaagaagatggaccatggagactgttccctctctttcccctattcatgttcgataaggtattatcttagacatgatgggacctctgacaaggcaatagttatttatctgtcatcccatttggtggttctgtcagattaaacacctttttagatactgtttccttttttgtttatgacagttatgttcttatgcttctccatgtgaccatcattctttcttaattagattctgtctataaagcatggatacggatgtgacacgatacagatgtgccgatgtgacaagtttggagaagtatgttacaacatggccatgagtcggacagcgtgagtctggcttgagccagcttgaatacaaggtgaatcaggcttggctcgaagttagcttgaacttgtttctcaagctcaaaatcaacaataattaaacctaaaaaagagaataaaatgaacagctcgaataggcttcacattataagtcttgaagtagggcatagaacatatgttttaaagagtgatagcacgtattatttgataaacatagagtgataatacattgatagtatattaagtagttctatttcgacatttatgattcataattaagtttggcttgcagtgttttcaactattagaatcaagttagtttttgttcaagctggaaccagcttgaatcaaattcataccaagcttggttgaagtttgataagagcttgaattaattttggattggtttgtttattaagctgatggagataaactcgtgtttcagcttgatttgaaactaggctcaatttaagcttgaataacaattgagtggagcttgatttcaaaatttaggctcaaaattaatttgaagttgagcttgaccagacccaggcttgattaacgtcagttaatcacaagccctactgcagcttattttctgctgctatttttgctactccactgctatcttcttctatgattagtatatcccagtgtcatagaataatgaatttcttgtgtttcagctcattgcagttttaatttgatcggtacttgtttctccacttacatgcttctttccatttgaagggtttcattggatttggtttcctttctcacttgtactacttgactttcgaccatctgttaacatggagactcatatgattttaatgatgcattataaagccgaagaagccatgattcttgtggttcattcatttttaatgatgaaattatttcattggttgcactgatgtcaattgcttttgagctctgactgatattcttatttctatttgaagggtttcattggatttggtttcctttctgctgtcacttgtactacttgactttcgatcatttgttaacgtggagactgatatgagttttaatgatgcattgtaaagccaaagaagccatggattcttgtggttcattcatctttaatgatgaaattacttcattgattgtgctgacgtcaatttcttttgagctctgactaggtgcaaacaaaatttatttattccaaatgcctgtgcttttgtcatattaaccaatatattaatgttagatgtgttctcaaatttaggatcttagatgttctaagcttttcctctttcatttcagttattgctgtcgacagtggaaagaaagcaatggattttcttggcttgaatgaagggaaggctgaatctcccaaaagtgatgtaagtcaactttcatggtaatcttttatcctacatttcataatttacttattgttctacatacttacccaatttccatacaatgatctctatcaaaatattggattgctcaacatctttggatgattacacatagtagtctgcctaaaagtatcatgggctttgccagtataatgggcaacaaaatgtttttagggaaaagctaaaaactttagcagcagaataattaagaaaaaaatgaaatgacagttgtagtttgcaagtgttgtccactatcatgttgagacttaaaattttgggaactcttgcaacttctaattttaaaatggaaaggaagtacattctaaaaataaggaaaaagaaaaaactttgtaataaaagtctgctatcatagacttcataaaaagaaaaatgtatcaagtgggatcttcttgatgaatttctctaatgagattatgcaaatgctgaagctacatgtgctagtatattaatgaagagcagatggtctcatgcaggtggcgaaactaatgtttcaacagggcatgttttatatttcatgaaatttatgcaagaaaatgtgaatgttggaacaagcagccaagaggcaattcagtgtctcatatgagtatattttagttttaacataagttagattgcatgcaggtatattgttatgacctgattgaaaaatagagatagctgaaaaaaggaactactaacgttaccagaactacatggactcatcaagatgtgacaaaagatagcgaaagattgttatttattgtgcatacagttaattaaggtgggatattggaaaaaagtaggtcagagtttgattgtgtgtttgactgtacttttatagtttagagagttctgctgtaatttggcttgaggagcataatatggtattccagggtggaccaaaacttttgggccacctgtcttgacctgaaccgggcctccagtggcttggcaaaaggagataaacatttggctatgagtgtaatgcataggagtttgtggattgttattcaacaggagttaagatttgtggacgggaagtgttgatccacctggtgtaccatgtcatgtaccacacaggaaagatgttgagttccagatgtatcgcatatgaggtttatgaaatctaaaggttacttcttgtatatttgtggatttttttgggggtaggggaaatggagcctcttgctctcgtatatgcaagctcataacatcatctctcatgcaattttggagagctgagggggaagtttccccaacaaaaataaaaataaaaaaataaaataaaataagatccttgaattcagctgcatgttgaacaagtcaaactacaggctgatttccaccatgtaggatatgggatgcgttggatggctggagagaggttctaatttgccatatatcaagaagacatgaatggtatgatgctgtcagagtccattctactcaacaaggaaattacagtagatgaatctcctctccatattgcagatgcctttcaaacccgtgtgacaatcataatccctttccaagcaacatgcagctcaggtataggaaccaagaccttactaaaatgaaaaccggccaccactgtaacagctccacccatatttctaatcatataaattagatcaatacatccacatctaataatatgtctggagtaaccaacaagggtagtctaagagttaagtcatctataatgggggatttggtgtaattgaaggaggacataaaactcagcaagagtttgagctcataccgtgaggaatctaattactaagagtttagtcatctataatgggggattgttgtgtaattggaggacaaattcagcaagagtttgagttcataccatgaggaatcacagctctatttgaccacctagctttaaatctctttgtatcgcttcttgacaaagagcatcttgaattttcatgacttcttatccacttgcaaatgagagctatggcaggaagtcagctgtatggttagtataggtggtgataatagccaacggatagtctggccggttaggtgggtatgctgaagggtggaaaatgcaagagtgcataaaaacgtcataaagatgataattgaggtggaaatttttttgtagagaggttgatgctgttggcaggtttagcaaggtaaatggagaatgtgagagcaaaacaggtaagaacatgatagaagagtgagatatagggtttgaaagatgtcaagaaaacagatatgaagacctaaaattgacttgatcttacttccttattcaccaaggttgtgttccaatgctggttatgcagtggatggcataaaattatccagctaaccagccaaacaccactcgaaaatggtgaataaattatttggccaacgagtgaaaaaggtagctaactaggttaaagttatttcaggaaggaaagtgaaataactttaaccaccaaaatatctctccccctctctatttttttgcttttccacaactttatccactaatcattggagcaccaaccaaacagcagataagtttatttgctggttagctgcttaggaggtgaataccaatggctaaagttattctaggggtggttatcttttcggcatccaaatgcagccttactctttggttacgtggccttctaaaaggctatcgaaagatgtgtctcgagcgaatatttcattttctggtcaggctgaaatgtcaatgccctcagttgtttcttctttactgcagtaacagtttgtacccaaaacttgtataaattatggtgattccagtaaaatcagctggtgctttggtgacatcttcagtttatcagcacattgcattgttcctcaagttgtattcagctaatttccattgcccataaccccactgaccaatcttcccttttacaaaatactcatcaatttggttgggaggaaaatcattcatcggtttgtctggccactcattaggaagaattcacaacctaatcaattatgtcatgtgatgcaggaccagaagattgatgttatccttagtgactattgtatgccagaaattaccggctatgaccttcttaaggctgtaaaggtatgttgttgtggtcccaattatcttttatcacctccagactgttccattctactattacgaataccatatgagcaatattaacaaatctaattaactggattgaccttgctcgcctacttcatgtcatttaataacttactttttcccttgtgtatcaggataacatttgctcaagatccatgccagtagtcatgatgtcatctgaaaatgattcccagagaattagcaggtcttgtagctacttccatcataatctgcatatccttctgattattcattttttccttctcaaaaaaaagggggaaaaaaactaaagaaaagaacttgtgcaagccaacattcactttaccttgcactatcatacatagtatttccagtgattagtgaaactacaatagaatagaattgattaagtacagtgggttgtgctttggaaaaccattagatcttcagaatcaaagtcagtcttaacccacatcagaaacattgtcctcaactgaagcctctgacttgtcataacctttttgcgaacaatgatcataagtccttaaaatgttcttacaccgaaaaaacaaaaacaaaaaaacttatgatttgcttcccagtacatcaacctttgctgaaccacaggtgtttccttttgcaggtgtctagctattggagctgaagatttcctcttaaagcctctacaagtgaaagacatacaaaggttgagaaactctgctaggccaacagcgccagcacccagccaagaccccaagagaaagctgcctgttgatctgatagcacagagcaatggttctgagcggcgcccacaccttgctggagttgcggtagcgtaatcgttcacttaattccaccttgtttttatcattaagtctacgtagtgagattccatggaggtctgtgttatcaggatctactggtgataagcaatatcttatttttattttcttattctttcccgcatgcttacaggcatttttgctggaattatgagaatgggagccatggatttatgttctttgcatgattgagacctcttcggcaggttttatgcatctattttgggatatatgagggaacaggataactagctgcagataacaagctatgatatcttttcacttgataagattattgcagcaggtgagaggggctaggtggagtgaagatgaggctttgctaaccactagggtctgatttggagggctctgagattggaaattgaaaggaactacaagtagaccggcaagcttgcatgaagggtgatactgtgatggaagcctttgtgtttgttggttgggttgagcaaggtattggttagataatttgcttttaaaattaccaccgccatcatcattttcagcaccgccatcaccatcattgacattactgtctctaccaccgccgctgctctttttttaaggctcttaagcttttctaacacttgaagtaagcatttgataaaactgattataggggtaaaagatggcatggcctaggttaaaatgtgtctgaataagacaacatagagcaatggtgtccagcttcatagaatagttttgggaggacacgtgcaattacaatcatgtagcaaatttgcctaatcaagttgaagctattcaacctaacaagctaagcgccatatgtttccttcctggatgaacaaaagtactggaaaatggcaacttcaaacaaatttgtctgaatttaactttaaccatgactctgctaatgacatcaacatgtttaacttgcagtcactgataaaattttttgaagaaataattatcagaaaatctccagcattagagaggcggctgcaacatcatattctgcctgtcatgaataatttaagaaatgctctttttaggtaagaaatttcataaaatgttttcaatttcaagagattatcattttagtacttggcatgatccaccatcatccaggcaaacaagagcttcctcacaagagcagaaatgacaacaatgtcacatgccttatagaacaaatcgctggatgaatcaagtttttcaatcagctcaacttatcacagctaactgatcaatttttaccaagctatttaaattcacagattaaaccaaaatgctaccatccattattccgcatcttaattaacagaaagctcaaaattactttcggcgagtgtttttatcatataaaaataagaaattatgcacaagaaactacacaattgcagggaagaatataattaatattataagttaagtttataagcaccttctgtacaaatgattccagtatttgccctgaaggataccacatgcaaccttcttcaagagccatcttgcttcggcttccggctcatttctgaatactgcccccccatcagctgcaaaatctcctgccacagattagttgaagaatctgctagggcactactaatcaactgtaagctgcatgcagcaacgacccaataatccgattcaatctcctcttgcagttgatcaaactgccacccagcatatccaacaaagaatctgaaatcctggggcctaagcacccctttcttgacaagtcccgcagcttcatctaagctgttccgggcgccaaaataaatgcctggaaccacctgttcgaagcctggaactgatgaattaccactggccttcagtacaaacatgctagcatcaagggggcccccaaagtgaagtgagcaatctgcaaaggtggttgcgaggtcaggattggatggcttcatatgcttgatcttcttgttgagagggcggttgagaatgactccaaatgggccctctcttgggtctctggttcctaatctgaggaggagaacaacagttctatcaaaactgcttaccccatcaagcttctcagttgcaactaacaagcaccctgtttctggcacggagagcgggtgggcccatgttagaccaagccgctgggatggcacatctgaggctgtgtcctctataggagcatcaggatctaccaactgcaccagagtaagcaaattaaagggttggcctttttattggacactgtcactatgtgtaaatacattttgtacagggaaaaatacattttgaaccctcaaggtattttgaagcttcaagattattcaaggccatgacttccccatggacttcaagatacaaggatggacaagattattctgaagctaactaaatgatcaaataaacacacttgctgcaatgtgtatgtattcaagtcccctcagtggacttcaagctattcaagtcaatactactgaccaccaatgttgccagagtggacttcaagatataatggtggagaagattattttgaagctaattacataatcaaataaatatactcattgattctgattctagtgtagactacaacattaaaagtttaaatgagttaaatttgaccatgacaaaatcaccatagcaataattaataactaagcaagaaatgaacaagaagcatcatgaaatttgacaagcagcatgagtggcatcgaatatccagaagcaaaaaatggcttcttatcattatatgaaatgccaaacttagcctcttatcattatatgaaatgccaaacttagcctcgccgttatatataaaagattctctaatggaatgatatgcttctctatttcgactagtcaactcacctgctcatcatgcacaagtttggctctgaaatctcgccaatcagacaatgtatgatgggacttgcgggaggactcactggattttgatttgtcgtgtaatggacgagttccttcagagccatctccctcaggaattgatggatcattatttcctgctaaccaaaaacaagtacaattaccagtacttaatcaattcaagagtacatagcattgaacatagagcatattcaggtgcaagaattcactagaagattcaattccattaaactaaacagtagttagaaattaaaaaagtgcaattctggatgctaggtcatttctgatgtttgatgatttataaaagaaatgagatttgaaatgttggtgaactaacaagtaaatggctaaccgttggaaatgtgaacagctagatgaccgcatctcacagtgtttcctgaaatactcatgatctagaggaaatagaggcggtcatcttcttaccttggagtctcaccataagtagatagaaatctcaagttccatcttgttctggctcagatttgtccctctgttatatgtgcatatataaatttttaaacaaaacttagcgaaaatgaaattaagaagttaaaattccaaagatttcatttcagcataaaacataagaccttatcaaccttaactacctacatttaaaatccttataagagcaggatatgtctccggcaaaaccagttccaactggttcatctttaagccccatactaatttctctgtgtcgtttataaacccataacctgataaccatccagcaaactccaaacctccagttttcatgatctaaatcctattagctctcattcaaaaaatgaaattagttttttcatcccttgttaatcatcgccattacataagatgccccttgatatggattccacatcagcaagaaattatagtttaacagatgattgctgttgcatgtgctgactgtgcttgaaggcactttcattgcatccctaggaatccttgaaagattgatcagcaacactaattaactttcttagttcaagatttgcactatttatttggagctcaatccatagttttaataggttagcttgctagattcaaattctgagtatttgttgcagatgggttaggtggtcattttccttgtatgaggctcaggaaactttgatgtttatattttcctgcatcttacctatttatcgcattgtccttgaaatgcattgcagtgcatcactaacgagtgcatttaggtcattctttgaggtttatcctgtgtcacttcgtataggagattatgttatgcacaaagtaaccaagcaatgagaataataacaacataattgactgttggtttgcaatcaagttgatgcaactctgggtgagcttaatcactatacctcaaggcagatttataacaaatggattatcagaattacaaccatggagatttgtatgtacatggtacataaagcactacgcaccaacaccaaaaataaaccatgggaagaaggcagcagcatctacagcctcaaacacactctgagtcataactgaacaaagagagcatttagtacccaattgaaacacaaggggtgcctctagatattcaaacaaaatcattattcctatggcgttgcatgcttttttttcaaactacaggtccttatgcatatctaggtctttgattatacaataacctataaagtatcatagaagtcccaacatcatgaattgaattgtctacgagtaaaagttttctgaatttaaatttttctgtgtcatctcacacctctcccatttctggaccttccctttttaacaacaaggcactttctagtatagccttatatttcaatttcaagaaagggacaaaatcatgattttgaaatttgaaacacccaaacgtaacttagatttgaccgaagaggcgaaggaggccccacagaaattcgcctatgaacaggatcctgtagagtataaatatcatgaaaaatcagataattgagaaagaatcttcatgagctcgtgaagtcagcatgacacaactgcccaacatctgcaattcacttccaggagaggtccaggagttctcgttgttcaaagacaaaaggcatgttcccagtttaaacttgcaactattttgccgagttttccagcagacagtatggaagataccaatcaaaaagaaaatggagaaacttttgacagagggtacatgcaagagagccttggacccagtttttgtgctaactgcaaaaaaaggaaatgctccctgatcctccaataaacacagacacatacatacctacatacatatatatacatattaaaaaggtctttctcctcattacatgtgaaggttggaggaggacttgaagcatgtaaagggagttctatatccattgttccgctcatgagagatcgggataaattaatgtagcaacagttctgcgacgattaacagaagaagaaaaaggcaaaaagaggatggaataagaagaaacaaacaacatgaagggccacgtttcctaatttgcatagctagacatttggcgatctatggtcggacttgaaatcttattttgacaaggtagttttggtcaaagatggtgaagagaagtgtgatgctgtattggcattaaaaaaaggtcattaaaaaaaaaaaagataatgttgatggttccaaatagtaaaaaaaaaaaaatctagttgacgttttccttgcgaatttaagaacccaacatgctaaaagagtcttgaagaggagacagacatattttcaaataaaagagccttgctgctccttttcttctgtttattctcattttcttgaacagtcttccttttaggcttcctttgggttaacagatgattgttagccacctttgtcccttctttagttttattgtaacaagttctaacaaaaaaaggccttcaaagggatttagcagtcatccactattagattatcaataggaggatttgaccacctgaagaacgtaaatctaattcctccttattcagttgtttatatagctattcaggaatcatatactagcaataatttgtatatatgagactccttagttcctacaagagagttgccaaacatttctataaatggggatgttgtttaaagattttaataactgctgaagcttatcccctactaaggcatggacttaaagtgagactaagccctaagagaaattcacagatccagagtgaatcttggtactttcttttttatcctcttacactcttttctttatttaatgctgtctgctttcatatctttattcttttggcaatcttgaacctaccagctaagctccagaatcccaccaaccactctttcagatcttgtaagcagccatctttacaaccatttaaacccagtcaacaactaaaaccgagcttggaaccacaaagactgaatgccattgagaacagatcaaatctgaacagtcttatcggctgttaaagtggcatgatgctgtgctcctaacaatcccaatgaatgctaaaacagccttgatgtgccttcttcaggccttacaccatcaattatgaaatattctcatgaatgcctgtagtctctctcttttcaaaccaaactagtcctctcttgctgcttaatcattccctctttgaatgcaaacctgaaaacctgctttctttcctttataaacagaaaaaaaaggatgaaaagaagtcatcttttatgatgcaaaaggcagaaagaaataaaatgcaaaattaattggtcaacaaaactcaactttgatcactatctacataagggatgagaaaggttcatagctatgagcgaattaggcccaaaagtgtctagcatcggacaacttagagcatggcctgcaatagcgcagtagggcctaaaaggtgggagaaattggagagcaagtaatttgattccttgctgatctatagcagaaaggcagaagttgaatagtttagtgggttgaaggaaacaacgaagatttctaggtcctttctaggatttagagatagtatttggtgctaggaaaagctttattagggttctaaaactaaagaagttctaatgttgacttaaaatttaatttaggcaatagtacatgtactcacacatttaaagagaagataagatggggaaatatgagaggaagtaaaagagttgagagataagagagatagggtggacaagagtagagatacaaagccacttgagaaaaaaagaagaataaaagggagacgagagagggataggaggtgagagagagagagagagagaggaagagagagagaggcacacaagaggaaagaaatcatttgccgacttcaaccgaaatttttcaaaaaaaaaaggtgaattgggcaacacagttgccgacttcgctcgttaaaaaccaaaaaaaattgaaacagagacgacccctatttcgaattggagttcaaaggtcctcctccggcctcagccgccctccgctcccttgacgctggctcgccggttgtcggagagctcgcgatagcggcgccatccatctgaaggcctccgatgatccaatgaggtctcccccgcttttcttccctccctccacccttagcaagctcagaaagagctccgacagccacctaaggccccctctccctctccttctctcccccctctctcttcctctctttcttctccctcccttcgagatggctgctgtgccgtttttcatgccaaaactagatccatatccccatcgatatggttcgacatggcctgcgtcgtccgatttgggatagttcagcggacggtgtttggaacattaaacaaaaaatgggcaaattcatttatttagaaacatcaagcatggatagtttaacatggactaacctagattataggttaatcacggcattttagtcaatcctgcttagtctttgatgctcaagataccaatcctatatttgttaaaattaatatgaaagagaacggaaagagaacagaaataaataacttattccatttcatgttaatcaatgcttttacgtggagctggtttcaaatctagttctcaattttcgcattctaacttacatcacatgatgtgttattgaccatttcagcaaataaaagaaaaacaaatatcaaagtgtatccaaaaatatacaatttgtaggtttacatccacaacttgtgaaagccatattgatagatatggaatacactttcaaaaattttcactagattttacacataattaggatatttaacaataagggcatgcaagaaacctttgataagtgaatagacaaaataaaatgatatcaaacatggtggactctgaagtatttcaaggaaaagaaaaatatagagaaattcaccaaatcttgaatgtagctgagataagtaataacaaactacaagtcaaaatggttttagattgatattaatcagagcacttgtttaacatggcacaccaattccaatgaaaaaaatgaacaaaacaagttattataaaatcctgaaaacctataattcaaatccaaaagaagtcaatctcttaaaaaattgtaagaaattcataaggcaaaactacctgacagacacaaaggatcgagatgttattttcttttaaacacaataagaataatcacgatcctaattttatgagaaccccaacaagaaacataagtcaaaatatctttgagactgcaacataacattctacttaagagaaaaaatgatcagtattcatctgtatgactagtcccatcatagaatttttgacctgacttaccaaaatcaagagcatgtgcaaggtctggcaggtgcaagagctaggaagcagagacttcccatgattttgagtaaggaagaacctaggaagttgatgcaggcatgagatttcaaatagttttcaagcaaggtatgacactagcaagaagaatctcgcaaaaaagaattcaattaaccatagttagcctcatgacaaatttaactaaacttatgaaagaaatacgggtcttgaattaagcttttaatcaactgcttaaatgcccaaaatggatgtgtgcccacaagttgtgcctctccatagatgttgactcaatcaccctcaataacatatctagcacctccaaaaggccttaaaccaaaaagaagttatagtcacaagcttttatgagcaactgtaactaacaatgattaaggtatctaattttttgccctggccttcatactggggggaatattatcatcttgggttgctcgctctccaaaacttgcaagcttgtctctcagaataaaatcactaaattactgtcttcagttttcaccacaatcattttgcagctaagggttcaaaaaatcaatataagtcgcttggtaattgagccttattgagctagacagctcaacgccaaaccactgcagcaccgtgccgaagtagtttgtccaggttggccccaagccacatattgcatccaacttcactgcctgaagatcaatttggcataacgtgtctctttttctgcaaaccatcactttgtttccgagcaatatctaaatcaacaagctgtctattgcatgttactgaaatcaacagagagacctcctccagtaccttttggagtcaatccagttttcaatcaaatcttcacttatttattcaaacctgacatctaatttcatattcagagggaatatatatatatatatatataataggttgaaccaggcaaatgcatgcttggatctagtctaacaaggatgctcaaggtaatgtagcgaggaccattgaggagaatattcacaatcttgtaggcgtcattagtaaagatataactgttaaaagaccagacaagtttcacggtaattctattatcaaccattgctgcagtgaatagaagtgctttcacatgattagaaacgggcaagatctgaccatattattaaactaggagaaactatgctactctgatcccttggaaaagccgaaccatttgtctaacaatgttagcagaaagcaacacaagttgtgaattcatctctataatggcaaaagaaaagaaacctatattcccaatattcagtttttccttttttttttaaaaaaaaaaacttttgttttccgtttggacttccaagaaaccgatgaacctaatctaaacaccgaaacacgaaaaagaaatttaaaagcatgcttttttttctacatgcatcctgatcaaacacatccatcacctttcccatcagatcgcacccaaacagcaccacccatctcaaaaaatcctataaaaaccagcacgaaattcgaggagcagatcaccaaagaaaacaaaagagaagacctttaccagaagaaggggagttatcatggctcttcttcttgcccgtagccctaaccacaagagatcggtacctaaaggaagaagtcctccccgccctcctcgacgaaaccctaatcccgagacctccaccgaagccgaggacctcctcctcgccgccaaggaccccccatccggcgctccgcctcacggtcagcagccccttgtccagcctcttcgtcgccgccccccagaccggacctccactcttgggattgagagccaagacgtccatggccgagctattgatctcggaattctcctcttttctagggttttattctcgaattttgggttggagtagggaaatttgggagaaagaatcgtttccgatggggagcgagaaagaggccagggattgggaagctacaagagcgagttaccggagtggggaggaaaccttggggtgttactcaccatccggtgagggtaagcgaccttttaactttttttaattaagcggggctcggctggatgaccggacctccactcttgggattgagagccaagacgtccatggccgagctattgatctcggaattctcctcttttctagggttttattctcgaattttgggttggagtagggaaatttgggagaaagaatcgtttccgatggggagcgagaaagaagccagggattgggaagctacaaaagcgagtgaccggagtggggaggaaaccttagggtgttactcactatccggtgagggtaaacgaccttttaactttttttttttaattaagcggggctcggctgggtgtgtcatccagctaggagtccagcaggaggacggccgttgtaacggtttctaaagtccatctaataagttttctccaataactggtgcgaatcaaaccaattctcaaaaattgaatagattttctcgtgcgttgtatgctattaaaaaaattgtgtgattaaacgaatggagggtgttcggatccaattgagtttgtggtgtagagtattaatccttgtataatgccttgccttggagtttatcattttttatgcaaggattagtttgtctcctttaattgggatgcatggaattatgggataatttaatagttcataaaaattatttatctaaaatataattataaaaaaaataatttttattatatttaactaataaaaatattattttaaaaaataatattaaaaaaattactatatttagttggaggtgatcgtatatagaaatatgataaaatttataaatatatttttcaatataaaataattttaaaaaaattatacagatatctccttaagtttatttcaatttcatttatatctctttaaatttaaatcgtctcaattagaccttccaaattatcgaagtgtatcgatgtgctccttccgttcatcttcgttaaccaaatgctatcacatgaccgtcacatgatattctatttttttaaaataataaaaatattcttgatttcaattctcagtcgagcattagccaaagcgtcaaaaggtaaaatcacatgcctcacgtgagccattattttggatgccctaaatatagagaggaggaaaacaagcgagtctatggtccttgctgagagagatcttcgatcaagctagccgtggtagagaaggagtcgccatgtacgccgcaggtggagaagaaaaaattcatgaaagaaaaagaaggttaccgatagagaaaaaagcaatgaagggtttccaatcgagctcttccagttacacctcctctcaaagtattgatttttgtcattgtggaaccagattgctactgagaacctttgggaccaccgcaaatcctggtcggcatttctttagatgcagaatgtatgaggtacagcaatcatttttgtcattttctatcacaatgtccaatctttatgtttaacttcgaattgtttgtcaagtaaatgggggctctgggttcttccattagcataatctcccttcaaatgctcgggacaatggatattattaacaagcttttgcaacgaaacaaaaagcttgatgaccaaatactaagctacaaaagaaggaccacctacgctgtttggtgtatgctagcatgctggattgttatgcttttttatataatcgattttctattttaaatatactgattgttctcgattgaatgtctcaattttgttttaaaagtcttgtactttgtttttgggacattttgagtaggttgttgtattttgtaattctttatgaaatgaaaaaaaatttctctagttgttagcaatgatggttgttataagtgctacattgttaatggtacagtatacttataagtttcgatgaacacccctgatattttattgctattacgcttacaccccctatactatcaaagcgttgaatatacatcccttgctttcaaaaaaaaatgaacaaagatatattatcttatacagtttcagaatacctataagaattttttttgtcacacgcatcaaaatatcacaacttttaataaaattttacaaaaaatataaaaaatttgactgacaaatcacaatgtatcagtgcatagacagaacaatccaaatacacccaagtggattcaaaaatacatacaaaatacaatgaagtcccaaatatatctaaaatggccttgatacaaccaaaatgtccttgatacatctaaaatggccatgatacatatcatggttgagatgaatggggtgctactgtctgagacaaataacctactgctgactggaagggagctggttgggagaaagaatgagaaggttgacatgtagtagcttctggctgggaggacagatgctgggagggagctggctaggaggaagtcgctcctagctgtaaggacagaggttgggaggaaactggttgggagaatgtacccactgaagttgctgtcttctttcttctcccactatctttggtctataaaaaaatacaaaatgataagtaaatatttattaattttaatattaaatataaatgtaccagtgatctctctcttttcctactaatttgactctcagtttgactaaatgcagtggtatcttggtttttctttgccttgtccttcctagaacctttgcaagccctggagttatggacccattgttgacaattcttgcaccttaaggatgtacccttcctatatctattagaaatttagaatctttgggcttatcattttcttttcttcatgccttcttgggtctacctggaggagcccttagggaaggggggatataatgaaatattctgtccttggccaagattttatgcttggtaccggctcaataatatgttcataggccaatgcctatgttgctttagtgtaccatgtactaacaaaatattctgcttccttcctaatatacataatagctattacagcatggcagcatgggatgccagttaaatcttataccctacatccacatatactctcctctaaatcaacaacaaatctatcattgtgatgcttaatttcaattttgtagcctcctccccatatgcagtggcagtccatggcctctaactttgctttttccaatttcttttgaatcttaggacatagggatcttataattttctgcaagcattctcttttggattgaaatcattgtatcaatagcctccaaatagtctccaacaagatgatgataggtttgtctcgagcatcaataatatacttgttgaatgactcgcatatgttgttcaaaagcatgctagacttccttctatcgctgaaagcatgcctcgcccatagctctggtggatgttgtcgaagccactgccatgttgtctcatcgaactatcgtagctcctccatggcagcctcaaagtctgaaagtgtgtttgctctagtacactttcaaaggacatctctatagttcttactcttaaatccagcagttttaaaattgacgtgcaagtgtcacacgcaaaatctatgatcagcagtaggaataacactcttgaaggtctccacaggacccaataaaagaattgaaaaaaataaattacgtataaaatcaagtgtattaagagaattgaacaagttttttaataagataaataaaccttctgtctgtcagacataaagatccatccatgctcttctaatggactaatatcctatagtaagttaaaaaccaactccattctttcatctcggtctctacaacagcccatgcaacagaaaaaatattttcatttctatccttccccactgcagctaggagctgtcctccaaaagagcccttcaagtggcaactgtccaaaccaatgatagatctgcaacctttgataaagccctgcttgtatgctgcaagacaacagtataaccttctaaaaatgggctggctactctcatcgacctactaacatccaacaacatcatgctctcaggattagtttgtcggattatctgacagtatttccacaaatgggcatactgctccctgtggctgtcctaaataatctccaatgctctacttttggccctataacactgtgctatgaaaatagaaatctttatatctctcctaacttgctctcgagagcccttgacactccattttgtgtcacttctaatctcatcaaaatacttctctgttagaaaggtggatgtgacattgtgattttcaaattgccatctacagttatatacaggttggaatatctttatttgataggtaagctcgctctgtacagaaaaagtatgaatcttccacctacatacgagcttgcatacagcagttatccgataggcctcattcttcttgaacacatgatcaaaatcctcctatatgctataaagccacagcactttcttaaactgtgtgacattcttaaaagtcattctaactgaaagttttatatttctcttaacatttgtgggttcattgaattcaggatattcagaacctcgaataccagcatctgaatcactatcattgctcaagctacagagatgggagctgctactactatttgatttcctaccagtaggctgctcctctccaaaaaaatcaactccctcatgaggtagagaatgatgtgcccaagatctcaactcctcctcaagtacatctctatttacataatcatcgaaaagatcatcgtcatccgaatcacttagctgactaagtgattcatcactgctgcttttacaggcaaccgtaggatttgaagtgacagcttcaatccctttcaatttcttatcaagtttaaacctaaagccacttacctttttcattaccaatctctttacccaagttcttggtgttgatgcattgtatctttttagtgggcatctgctctcctatgactgccatacacaccaacaagctttgtttgtctgtttcagataaaggaacatcaccagcatttgcttggtgctcaacatatacctcaaccatatcagcacctcgcattgaacctaacatctccaatatgtcggcatgacatcttaatttcctcaagccattttgtaatgtctgtcatggcattaggtaataaaaatggttacaatttgtgtatcctaactagctcatcatgttctctatctctgtgatactaaatctgtctttatcacaattatcaaagtatcgactactatcctgactgtaatggtaggttagatggtatttaaaagatctactataatgaatttgtacagtaaataagttagagtctatctctgcacaatgaataagagacatagaatactaaaaatatgttatgagggtcataattagtttcattggctgattacatttgtcaattaaataagtcaaagtccatgagaggtatgccagaagagaatctgatctttttcttaataattgggttaatctgatataacaattatatggacatgtacaaaagataaaggacactaaaaaatactaagttaatcagagtctatccctacacaatgaacaagagatataggacactaaaaattactgcttggctaaactgaaacatttctaaaaagagaatgatatttgactgtagaaggcttcctgtggatcctatctgtcatgctcacgtatatcaaaaataggaccacaaaatatatgaggacaaagggaccacaaaaatcaaagaaaaaaatcctaaaagtatcggtttacaaccataaaatcctaaaactatcggttggccactaaagagacatacatcaatagaataatcaccataatcaaaattttatatgaaaaatatattgttaaaagatgtattatcggcaaaagaagatataaggctcatccacagataaaaataaggtattcaagaggctatcacgctcgtgcacaagggaggagacactgctcagccaaaatggagagtgggatggaggtcatcatcgaaatcttgtcgaagaacaatcgtcgaaagcaacggatgcaaaatgacggatgttgaaaaagggagggtcagcattgtaatagattttgaaaggagggatgggcattttcatcttttcgaaggataatataatgatgttatcacttaaatggacggaaggggcacattaatacacttcgataatttgaaaggtttaattgagatattttaaatttgaaggggtgtaagtaaaattgagataaacttaaagaggtgtctgtataattttttaatactaggatagcattatcattttcaattaatttttatataatgaatataatcacataactctttgcataatgctatcttcatcttaatttttttacaaaagctctttattgaataaatttggatagacattaaaacaaatttaataattacatatgtagctttattgaagatatttctgtcaggtatagattatcatcatttagaaattttctaaataccaacctctcatagtatttgttttacattctctcttaaacatagggcccatcaatttttttatcatttttttatttcattttttatactaaatattataatttgatatgggattcattttttcataccaaattatccccaaccaaaacaaactttcagagcatcttctttttttccaatgatagaaagcattttcatttacagtgtaaaatgcttgttcttaatagttatattatattatttgatcacatttatcaactttaaaaagtgattattttaggtatcaaaaatttttaaagtatattaaaatataatgttttgtcgtttttgaagaaggatgtggcaatagaattatagtcaatgccattataatgcattcaacaagactatactctattgcttgcaattgcatgtgtacaatgaacgataacatatatcatctcaagaatttaaggattgaaagacttcacctttattttgtttttgatcaaagcttgggagaagaagattcatattatgctctcaagttagtgaggtcatccttaacttcgggcaatgtttgtaaaattggactaaactgaccgatttgactgattgaattggaaaccggttatctatccaaaataatatgaaaatactttaaaaataatcaaaacttggtcaaataggatgaatcggatgaaccaatcagatcgactgaatttgatccgattctcatgggtttaattttttttttttgagctcatggcatgtgttcatcttggagggccttttcaagcattctaatttcacccatgagtcttgcatgcctcatctatctccttaaccctaatgctaatttcaccactcccatcctcgtcctaaatctctccctctctccttcatcactggaatctagtgcctcccaactttgccctcgagagtttctccaaaccttagcttctctcacacctagtctctagggttttgtggtgctcaaggcctttggtggtggggaagatggagctgtcatcatcatcgttatctatgtcattgctagagttgatgcaaaagaagctctttgatgagataggaggtgctcacaagttttacatcaacacctcccccctaacaatatccttcccttgctctatcatcctccaagttattctttaacccaacccctcccctctccctccttaccctgctctccctctaatcacttcctcatcgaagcctccctttctgccttctttagtgccaccaccaccactcatggtactcacctcaaggttatctatattgggtcctttctcatttgctgcactaccattctcgacaacaccactactatccaccacttcatcgctagccctccctccttcgtcccttccaccctacaaggactaaacaagcctgctctattgaccactcccttctctcctcttttctcgactctggccagctccctctcctctaaacttcttaaagagaacccaacagggagatggtgattgcagcaccaaaagagtggagacaatgcatgaggtggatagtgggggagcataagaagcacttgagagtaataaaggagtaaggagtggacatgaggggcagagaggggagaatagtactgcatgtgatagtggggagggacatgtgagatatacaacggcattggtggatcaatcaaactgacgtgcaccaaccatgcgtgaagagtgaggaaggatgcttttcgagcatgtgagatgagggcaattaaattggccaatcagatcgattagactggtcaacccaagaattggataacttgatggttcactatctaattcgattttaaaaatattacttttttattatcttttatcgcactaggcatttatactaattaatatttacttcaatggatagaaacaatataattaaaagattggatttgttctctaggaatttgctttatgagaaatagaggcatgaatgtatattaatgcttgacatgctattgaggagatgtgttgttaccaaaaaaaaaaagagacgagaagacatgtttaggaaagtggatttaaggctgagagtttgcttcattgatagtgcaaaaatatagatatggatcatggaagtgtcaataaatgcatcaacacttctcgtgagccacaccaatatataatctgtattcgtatgctcaaaaatataacaggtatcatattacaactccaatgaaaacaatgaaagaagcttcgggccattaatgcgcacatgagaagttcacgactcacaaatctcaggaatggtagcagatcctatgacctgcaccgacccaagtacattagcttgcaagaaaattatttaaatatgcacaaaataggagtcctataacattactttaaacgattgatattatatcaagaatggcagctgttgtcatatactttacaatatttacaaaataaaatattattttggtatcaatgcaataaatacaaatatacaatgaggagtcctaactgggttaaataatgtgtttttttggctattataatcaatctgttatgtctctttataacaagtcaataataacttttataataatatattgacagcaacaaaattaggatgatcttatcaattgaaccagttggcaacccctctctccgaactggtatttggccttctctgaatctttttgccccgtggggaacgtcgcaacacgccaaaagccgtggcgcaggttttgcaaccttgaatggtagatattaaatatggataggccaaacagtggggtccatgccatcctacccgaattaatccagagaagcggggctccagattggagaagcatgggtatgcggaggccgtgacccttttagaacctcgaatatgctcaaatatgtgagcgcggatcctctgcggtaccagtctacgaatattttgttggggatggtatggctacaggtaatggtatggctccaaacaatttaccaagaaaagctccatgctcgcatggcatgttgcggtgccaagcaccctcccaacatgagaaattatatcctgtaccgtatccaccacatgatgatcactggggccgttagttcattcgatcttgatagatccgatccgatctgaatcaattaaatttaaaaattaaaaattaaaaattaaaattaaaaatcgatctatataaaaaaaaattcaaatcgaaatcgaacaaaaaattttgatttaaatcgattcgattatttatttttttattttttaatttataattatttatttttgatacaacatattcaaacaattattgtgaattcattggtttgttacatggcatttaattaaattcagaatacattgaatttataatttttaaattaaaaattaataattgataaataatgatacattgataattaataaataataaatcgataataaataaaatataacatatcaaaaatcacattatctacaatacaaataagtaattaaatattacagtaaattttaataatagatcaaatctagatatccaatcatccatctatataaccaataaattctcaacatggtaaacaatataaatttaaattataatttcaatttttcgtttgatttttaaattttttgatttttaaccgaaccgaatcgaaaatcaaaattcttgaaaatgaaaataaaaaaccgaatcgaatataagaaaatcgaaaaccgaatcgaactatattcgattcaatttctgttcgattttttgattcgattcgaactgattttcgatgtgaaaccgaattatgaacagtcctaatggtcaccataccaaccatctcacttcattcctatgtactccatttatcatgtacttagtgattagcctacaaaaatgatataaagtgatagatgtggtgccctaccatctggtgtatgtgatgtaggatataatttttctaagattgggcctaaaaaacttttttcttcttcaatttagtgatggagataaaataagttcttgaaatctcttaatctggacaacacacaactctaaaatttatattgacatgctgactctcgaaaaatttaaaatatatttagttgaaaaaaattgggctctagaacataaaagaatgactctcattcttgccattagacagttagactaggaggagacatattgtcatttcgatttcaaaaaaaataaaaatacctcaatcccccaaagcccaatgcctactctcttttaatattcaaactctatcctgatttcaattctaaccacgaattaaatacatcaaaagatattgatattttgattttcattccaatccatttcgattctacttccgactgtgaatcaacacccacttaattgaaatttcaaaagaatccccatgctacaatggctcaaggatacaaaatcaccacccgttgagttccaacataaaacccatcaaacgacgctgagttaccctccaattgccgtcatgttctagacttaatgcacgtagatgcctaatactcatcacctgtaacaaccaaatttttgatgatatttgaactagctaataatatagaattatagaaagtatcagtttttctaagcaaatgatcatcatacctacatcccacatctctctcacgaaaaggaaaaataaaaatactggttgaaatgattccgaaaaggtaaccatatgagaagaatattatgagaataggtgcaaaaggcttttcacatggaatctggagaatacttctatcaggaagatgtgaaaatagacctagaagggatttggtaaaacaaaatgccacaattttggtatcatatactgagattatatgctttcatctaaatctttatacatcatccaaaagatgttagaagaaaaaagaaaatattgaaggctaaaaaaggacaatgaattagactgacgtagaaaacatagtataagtgggtgcaaaggtggctatcttggtgccttaggaagtcttttgctcaagatgaatatcccagcaatcaaaagcctaaatatcgctcagcagttgaaaagagaagggacctggcaccgtcctaccagcaacaagtaaatatactacagtgaccatcatgcaccaggtgagataaatttcttcttaactatcaaaaaaggcacaaaataggtgaacatcttcatatcccatgttccttcttcctgtgtgcacatcatacaatgcccaattcctatgaaaaaaattgcagcattgactccatgaaaaactccatgatacatgagcatatgctcaccaaaggccaaccctatttttgtgtggtttcatgtgcactccatgcaaaagtcttggactttacacagggataggcatgcttgaggcacttattctagcaggacactcaggcctcaaccataaaataagaactaaaacaaacagcctgattggtgccatctgcttttcccttcgtgttcttcattagcacaggcacccaaaaagggcaaaaagaaaaaaaaaagacttaaagctccaccctatcacaaatctccttagcttcaacattctttcttgttctagaccactcatcactctatttctttgttttcatcatccagatggaaaaattattgccccaaatcttcatatcaagcaagtaatactcaaattaaaaatataacttgttgaataacttgaaaaatcagcataatcgaacattaaaaaaaaaaaattaatgtacaaggttaactaaagtgcaaaagaataaaaggataccctgcagattgtatgtagaaaatatccagaacattaatcatggatagaaaagaaaataataaacaagaagttcatttatcaagaaagtcaaagcagttcacacattgagacatataaaaaattgttttttataacataggtagctagatccaagctacaaatcctctaaaaccaaaacagtaaatagataaaaatcaaacctccaacagtctccaagtaataagtttcttgcttcggttgatatttaagctccattctgagaaccaactgtagaaaattctgacttgcttaagaagacagcaacaggattaccaggtgaagggggattctgagttagcaatgagatatgtgggccagctttactacgagcagcatcatcagaagcagacaaaacttcaacatgctcaagacccagttgccgctttatcaaatcggagttctcctgaagaacctctatttcaccaaatggcagcttcaaatccagagcctgaagaccaaccaagcgtacctcatccttcttaaacttcaggaaaggcatgcagagtttcagtatgttcttaaagtttgcatcctgccccacagcgcttccttttaacgcttcaagtatttcctgatcaggtgcaaaggaacctttagcactgtcaaattttgtttgaagtatcctaaggcattcttctttccaaccatcatattgctcgctcacatatataagacctactgtgaacttgttttcctctgctggagtaacaggagcaccctttttagccttcttagggccagatacttgcttctgaagcaactttctcatcaacgctattgaatcctgcagatatttgttcgctcttctgagaagaagatcaggggcatctgccatgggccaaccagcattcactacaaagccatccttcttcaagatattcttccatacatgctcggcatagtgcgggcaaataggagttataagtcttgtctgaacatccataaacctccacaacaagtcacggttcattcctcctgccccacacgaaaacctatattcatctctggcagcctgaaggtcataaaatcctaccttgagagcatccctaaacatgaaatcattatagtgctgttcagctgttttaatggctatgtttatttcatttgcaaatacacggtcggcataagtagttggggggccagctcgcaaacatgactcagaaaccaaaacttcttccatccaagcaatttccttggtaagcctcaaaattgcagaatttgctgtttcaaagacaaaatttgcatcatccattccatccccagcatctgcaagagaaaatctggtggcatcagaggagaattcctctatggcctggcgaagggttctaaagttccctgtggatttggacatcttctctgaattcagcataagatgcccattgcatcggaaaccacggggccactgctcttttggcagaagagcagtgtggttatagatgcaaaatgtaaggtggttttgtatcagatccttgccagatacacggagatcgaatggataccaatattcaaactcatccttcattttcttaaggagagatgcagggatgtctgttttggggactggccctagaccaaagacatagtcccatacttcatctgtcatctgttctggctttactgaagaagtatctaatccatacatatcaccattttgcaaaaggtgagcaatggtgtagtatgccatgtatagggttgagtcagaaagtgattcaacaagaaactgctcatcccatggaatatgggtaccaagtccaaatgaccttgaacatgcccactggttcagccagctcaatgtgtgctcaaaaccgtgccgtgtctcttcactatagagcatcatgctggccaaacagtcctctgatttttccttccactctgtctcaccataagtaatataccactgatctgtaagtgccacgacacactcatcacctgatcttgacataactttcttctcaggctcactatacattaccgcttgtccggtccccagaaggtcattccttatcaaaggctttgcttcttgaactttcttccctttaaactcccccaccagcattgtaccatcagtaaagcctttcaaatatgtcaaccttttcgcctctgcaagcttatctttatcattctggctcttgatcttcagatcagtacagactttctctgcagatacatctccaaactctggaatattaatgatcggtatgacctgaaaaggcatgacccattcatccttaaccccaaattttgatctcaaagctggttttgatttcaaatcttgcaatgccatatagtcatcaggtgagtcactgggcacactggtcacaattcctgttcccttgtcggttaagatagtaagcatgggaagtgagtatatggtttcgttgaaagcgagaggagactttaaagacaaaccaatgagatcatgacctgtcagctcaagcaaacaagttggcttctctggaacccttgatagtttctgataagccaggttaagtgcagccctctgggtaataatgaaaacatcagtctcattaatctcatatgctccatacttcccatctggcagtacccaacagtttgtttgcccatacattgtctcaggtctcaaagtagcagctgccaagtaaacttttctaccttccaagaccttcaactgcggagggaaaggtggggttatctccattttgattaaaacatactcttgtggctgaacaccttcaccagaggctctatcatgatcagcacatggctggccatccaacggagagtaaattgtgtacctcatatccttcacaatcttccccatgcccttcaacttcctcatctgccatctaacaaaggaatcatagaaaggattcatgtctgtagttataaaagagcgtctccagtcacagcccaatccaaaagccttgagatcctcttttgccaaaggtggaaaataagtcaaccagtgatatgggtcttggaattttgcaatatcactgtccgatagaccaaagcttctcattatctcccattgtgacttatttccaccagatttggcaacagccttggaccttttgctcttaaatttattgggggcaaccacactactgtcttcaggttcgctctcttcaacagcttcagtagtagaatcctcctctgtggaagaaaacacaggtggatttccaaactgctgaacctctcgtgcaagcttatctgctgaggccttgataggcatcccggtgcaatggaatgcaaagggcaggagaacattacaaccacgcagacggtggtatgcagcagcaaactctagcttggacactgtgaaggcatggcccaaatgaagcaagccattcatgtatgggtacggaaagttgccaaagaacttctcgtcgggcccaggaggcttgcttccagggttggcctcgaagactttgtgttcttcccattgtttttggacttctgactgtatcctaagcagttggtctctcctagaaaagctcctacctccctcagtgtttgaggccatttctctgttatagtattgcaagaattcagatattttttgcgatcatattcgaataattcaatccaataattgatactgggtatcaaaatcaagagcttctttaaacagtaacggaaaaaaaaggatcagtcaagacacaaacaacaagaaactcaaaagaatatctcaaaatcgatttttttttcagattatccactctatgtctctattatttttcattacaactgtgacgaaaaagggagaaaacttatatcatcaaaaaaaaaaaaaaaaaagtaaagtaaagaaacttcaagcaacataatataaaatcatcagcaatagcacataaagtgatcactctagctttgcttacagccaccatattccagccaaccctaataatactaaaattcgagcaaaaatacaaccttttgtcccgagccttgaacagctaccgataatctacaagaaatttcaaccaaaggaaaacatcaagagaatctaaaacattacaatagcctgacaaatacaataagacccagccataataatgctttccctcaaaatcaaaagatcaggctcgcaaacaagcttcggattgagaaaaccaataaaaatcaaatattttcctacagaaaagcatggaaacaaataggagagcgtccaaacaaagagattggatggagattgggattcaatcctaacctggagagagtcgggagtggaaacctggatcggaaaagggcgggcctttgaaggagccgcttgaagagaagggatgaagccaggagagacccaaaagtgatctagggtttcgttgcgaaggactgcaaccggaaaaagactggtgcccacggtcctgcagcggtagaattagccgctctctcaagctaggagaagagggtttaaatagtgaacaatcttagccctccatccaccaaaacggaagacgtttagaggatgaatatcagctcgtttctattgaagattgtttaatgtcataataataataataataataataataataataataataataataataataataataataataataatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttgctttttcggagatggggaagcggaggcagatgacggcggaggccggtcggaggtggcggcgaggagagcaaacaggaggtcagcgttaaagaaatctgtgggaaagaacgcacctgagaaagattggagagaagaaggcgacgacagagaccagcggggggtgacggctaggagagtagggaagaggtgggcattcacgacggctctgccagacggtggcggcgaggaggtgggcgctcgcttagggctcgagaggagtttgaagaaaaacaaaaggctgccgctgaaaatacaccaaacccagctcgcaagtggcgtccgactctcgttcgttgtattgtatagatatttttaatttgggttggaattgggtcaagcagttcgacctatcacgggtcaagaaaatcccgattgggtcactttggtctactattgcaaaatatattgaagctttcgttactagctaaccccatctttagctgacttgaccacttgtcattcaagtatttcaagggtagcacactgatatagaatctacaacaagtcaagtcatgatggtttgagctgcagtgaattgggtttggtttggttgcgttgggttggatcacgtaaaacgtatgacatgagtttattgggtgggattaagcctacaaactctgtccatggaccggtttttcaggttttcagttaggatacataaaatttatgcattacaagtcaaatttagcaacgtttatgttttgactcaatccggctcatcttgaccatgccaccatgattgtagtacattgccccatttaagaaattagattttcttggaggtttttttttttgcccccttatatgaatcagatcaggcatccgagaatgtaatcaagttcgtaatggacttctttaaaaaagaaagaatagttcggaatgagaatttgttccaaagttatgttggtcccaagcaaaatttttagcccacttgtggtgtggacgaatgtttcttttagtagttgcattgctaggattgtatgttggaatttaatctgattaaatttatccagatatgatccatactagcatgcattaggatttgtttacgtattttaatttaatctagactctaattaaagataaactttcaataaaataatatagatatatttgattgttattgtgttaaagtcaaactctacgtaatcattatggataatgtctatctcaatatttagatattaggagtagcaaaaatcgatacgacctgccaaatgagtacagatcgtaaaaagttaacctatttaatatgtttaataatcgaatcgaattcaaattttaaacagttgatccatttaacccatttaataaatggattatgataggtcagtttggatcgagttgtaacccataaactcgcaatactatggcttaaagtattaaacaatttaaactgaccgttgccgttgatccttcgcccttcggtcccatcttgagtataaaaggctcttactctctttccaccttcgatccgacttctagatctagggtttttgggtttccttcttcagtcctctactcctccttcgatgaccagtgcttctagctttctttccattttccaatggcggctggaggtccttcactcttttggtggccagtgcttccagctttcttcctaatagcagctgggcgaactgtgaagccaaacctccttcggtttcctcctttgatttccttcttcgatcctccttcatcattggtccttgagaggaagaagctgtactcatcagcactcgactatcactaagggagcccaaatctatgccattttatttcttcttttcctctccaacagccattgctaaggaaatttgtattgcttggcacctcggtcactcgagatctaggattttttttttcttattttaatggctcatgctttttttttccctaacgatcgtcactgatatcttgttatattatattttatttggaacttctttttaatttttgtttgactaagaataatggatgttgttatgttgtctttgtttgaatttttaggtacttgtttagattttaagcaattttgagattgctttaagatttatatatggagactataatgatttttcgatatatgtttgatgattcagctatttctagcagtaacaatcttggacagccttcttgtataggtaatcgattatcgtcattttaatttagttgtagattaattatcggatctaagcctcatcttcctcttctagatatacatgggtctttcttttccgttctttgttattctaatgattttcatatgtagcaatattattgtcattcttgagatggataagaatttggataagtatttccatatatttgaagttgtaggatatatttgaattcttcactctttctctatcaatattttgtactcaattgaatattactaaaatataaaattttcatatagaaaccaagatgagttctttctaaaaaatcaatcaaaaattatttctagctagttatttttgttcaatttaggatggtttagattttttctatatttaattttctatttaaattttatgtaatattgtacgatggatatctagttcttagtaccagatcttttcaggctattgtatttattaatcttggcagctttctataaaaaaataattattattttttatattatattgatcatttgattactgttattatttaactctattaatttaagtttacttattttttatatctatttttgatgtttatatttaagtttgttattaaaattaaactaaacaaatcaaaatttaaatagtattggcccaagaacaatcaattttcttaaacaaacaagctaaacaaatcagactagattagttttgttaaatagattatttatttagtaaatagattaaacagattgagtcagatcagttaaacatgttactcgtttaataaacaagttaaacggggagaatcggatgacttatatattaaacagatcggattcagatttcgaaacctgatctgtttaataaacatgttagatatagatttgatattttctgattcgacccgcatctggcccgaccctttacgatctgattcaattgccatccctattaggtattgtttctgatgaatgaggcatgttataaacaaacaccccttatagacttgattcccaacttatccgaaagagcttgtgaggtcattctgattaggaatactcagtctgattaggaatactcagagttgagattggcaaatcaaaatgctacttagagataatgaagagcacattgagttcaatttttttttgtgattgtaggtagactgattccaaagatcacaaatgatattggtaacttcttcatgtaagttttattatcgtataaaatttattatcataatatcagagctatatagattatttggtttgaatattgaaatcctttttatatctatataaaaattttatgaatataaatctttgaccagccatcttggttggttgtatgtaattgaagttgtcatcattagtctaacgatgcattcatagattttatgattgtagaagtccgtattgttttattgttttatttatttatttatttatttatttaataagcttatgatttatttttttaaaaatttaaattatttttaaaataaataaataaataaataaataaataaataaaaaaggatgacgacactcatgatttctcaccgccacgccctccctctttcattcaaattggtcggactctggtctaccccgacaatcaccgcaacaatttccgctctccagcagccaccgaactttcaaataaaaaaaaggagggtgaagatgaaaccgtcggatcttgatgaattgacggtttcctctcttggtaaactttgttacttagtgtaataaagttgcctccttacgaagaaaaaaaaaaaaaattagccgacggagtctgtaaaaagtgcttattgtgtaataaagttgcctgcttgccaccaaaaaaaaacacaaaaagaggggcacacttgagactaaggtacgcttcaatctctgttcatgcctatcacagtatttatcctcacccacagatttagtgccgtcgaactttggtagctggctacttaatttgatatcttcagtcgaccatttgggcattgccaatttctggacaaagtgaaagtttccagatgactttgtgttctgcaatcaaatttattctcaaaacttgtctctgtttagaaagccccttgcccattaggctgattcgttgctgtgcagaatgggaaaccaacccagctcaaaaggaatcatcaagcacaaaacatgaatcacaaccacattggctgatggatttcctctgtattttgctggtcctgtgtattagtaacaattgggaaccactgcatcagaacacaaattctcctctctaaaatgttcaatgactgaataagaactatcctttctatagcatgcaaacctggagcaagaaccaccaaagttccatcataagtatcagtaactgcatttgcttgcttattcctctttgcttacaggacaggtaatattctgatgtgaatatgattaaagaggtctttagcatacctgttgagtatttataccaacactacgtgcagcacttctgcattccagtacccaagtttgcgtgcctcctactattaaatgtcgctgcaaataccggaaaagcaattgcctcatcgtataacccctccaaacttcaccacacacgaggcaccacatatcagctgcagcattaaaaattagttacatgatataaaataacaggacaagtagaagccagaaagctccctaatagaccagcttcttagctaactaatgtgtagcagaatagcataggagtccagcactgtcaacatatttggtgcttaattttaaatcaggaatcctcttataaagcatgaggatacaactcccagcagtgaaagcttccggtgcaatatgatccttcgaaaacagataatgcatggagaaaataaagagcgatgagacaaacaaacccatggcatagggtacactttgctctaaatcaccactcatcatacacagctatgggtatgaataaatattctacaacagaaccaagaaggctaaaataaaagaaatcacattttgcaacagaaagaaagcaacttttaagaaaactagcagaaaacatggtgacagcgcaggcttgtgcaaacaactgagaaatgttccacataattcttggagaatcaatttgcagttagcacctgattgttcccataattcccttctcagattcgctgtggaacaagagcaactcactacacaatctcatcatcgaaacatgcagacaatttcctctctctttctgggattaggatcatacatttccatccatatttctcaaaggggctgaaaactaaaagcaaaatacattgacatcctaaagatacggtggaaggccacccaaagtgagcatatgatcccaactaatgcacacaaattagaccacaagctctgatcccaaaattgtagcatatcaaaacataggccaaaggagcacctctatgaggagcagcattgcttctttgcattgctgacatccgtggtagacacctcaatggtcctcccctctttgatgcctccagtaggtcctagtgaaggctctgaagaggacagaggcttcttactgatgattcgatatatctctgaaaggatcatctgaaaggctttctctacatttgtggcctcgagagcagaggtctcaatgaaggacagaccttccttctcagcaaagctctgtgcatcctctgtggcaaccgcacgaaggtgcctaaggtcagtcttgttaccaatgagcataaccacaatgttagagtcagcatggtcacggagctctttaagccatcggttcacattctcgaaagttgtggccttggtcacatcatatactaggagggctcccaatgcgccacggtagtaggcactggttattgccctgtaccgctcctggcctgctgtgtcccatatctgtgcttttattgtcctcccctctacctaaacattagaaagaataaataaaacaaaatattgggataaaatagttcaaagacaaacataccaaatgtcagctttgttgtcatattttgctgcttatgacaaactaaataaacaatagattctattataaagagaagaataatctgaattgagaccatagaaatgaaatttagaacaagatgagctgaagctttgttctacaaaagctcatggtagcaagcagcttgatcaacagaatgaaccccaatatatttgtttccatttgagaacaatcagtgaacatgaaaaactgactcaaaagatggaaaaaagaacatctataaaagaataagtccttcaaaaaaagataagcaacaaaaaaaaataaagcaaatttatattaatatattgacacttgttaggttatctttgcagatcacaaaaatatatatataaatcaaatattctgacatatcctaacgaaaatgtttctgaaaagcagataaataatacataaacaagtactaatttgaacaagagatgtcgatgataaaatcatgcacaagtttgcagtcatatctaattatgacagacaccaggataattttacacaagcaaagaaaagaagagagactccaagctcagaaacaattcatcatgaatcctccaaacagaagtcttgcaggttgaacaggaataaagttttcagctgaggaaaaaatcatgacgttgacctttcgagtgaaggaatattgtcactggttgatatggctaaaggcaaaggggtcccacattggtgacagatgttcaagtaacacatatttgctactcatgcaaatgaacttatgtttgtttcagctgaaactaatcatatagctgcacagaaagcttcatacataggaaccaaatcttcctactaatttttgaaaaacacttctacagacacttcaaatccagagctgatcaatagagagatgcatcaaaatggcatcacatattgatgcaatcttcgataatttcactcaataatatgtttggatgattgagcaaagcatcatttgttgagaattcaatgtcacacaaacttaactattctaagcttctattttctcccttttttttcatatgacagaacaatagtgaagcatatcttgtctggatgttaaatcagtctccatttttgttttatcaccttttgattaaaaatgaatcaatatataacattgatcatatttcggagtgttatctagttagaacatgagtttagaaaggagcttcatagatagcacagagtgagagatcacgaaaatgtagatgtcaccttgaattctgggatttgaatgccctatcattatgtgacataaagaagaaattagaataagtacaggaactatagtctagaagagaaaactatgacttataatggaactggaaaatagatagtatgcacatgcattgtgcatgcagatggcaacaatgaatcgtaatgctaaattctaaggaagagcatcacatgaagacatcactcttggtttacttgttgctccctattttaagggtggggagaaagaagacaaatgcaccaccaaaagtggaagtatatttatcatataaatactggaaaagatctttgatccaaaagggccatgggcattgatatttcctctacacatcactcttggtttacttcttgctccctatttaaaggtgaggagaaagtaagacaaatgcacagccataagtggaagtacatttatcatataaatactggaaaagatctttgaaccaaaaggaacatggtcattgatatttcctctacacatcactctcggtttacttcttgctctctatattaaaggtgaggagaaagtaagaaaattgcacagcgaaaagtggaagtatatttatcatataaatactggaaaagatctttgatccaaaaggatcatggccattgatatttcttctcacatgcattacagataccaactcttgtagtaaaaactacacctatgcctccaaattgatcacccattagacgaaaacccagttcttagctaagataatcttgtgacctgcctctaatatcactaaataaaaatactggcatgacaaactaaataattgctgaacattttatgacaagaatttagaggacaaggaaggcctctcagattattacttatatttgattatcaaatacaaatacatgcacatgttatacaccaagatttgcaatcttggtagcagatccatgacaattccatgttaatacagtatcaataaacccagtatgggtttggtttggcataccaacacttggtacactagccatcctgagtatcagtttgctcctgatatcatatgttacatccagtatcgggcagtatgtgaaagcatggcaaaccttgttatacattaacgaatagccaagaagaagaaacattatgatcatatcaatgatgattggttaaattcacaaatagctccagtgccactgtcacaaagttatttcaactaaaataaggacaacaacaatcaaatctacagttaagcctcctaaaaattacaccaaaacaaatgacaagacaaatttgtccttaatcaaccgctagtcaaatgggcatgtgcactgcatattcaatttatgttggataaagtaagaagtatcataaaaaataaatttctataacatgcaattttaacataaaacatttcacactataatttatgttatctggagaaataatagttctaatatttatctcatgctcataatatttttgataattagatacatcacaagaagtaaatgcaatgcataatgagaacacaattatagtagcagccatggttctgcacattgtttcttatgatagctttgagcacacctcaaaataataagtacacaatgattgctgtatatctgttatgacaattataataatgttaaacaacaatcatgatgcctaccacttatttaacctaataaaatgcatgaaatataatatttttctatatcgatatataaataaagtatatacgaaaaaatattgatatccaaaaaatatcatttatgtaataatattcacataccctcatgtcatgatgctgccaatatccaagtataattatgctggcctaaatattgatgcttaatcttttaaaagcatattttagaacaataaatgttactatattatgattgagatacttgtttcagatgtgcattttataaaatacttttacaacatattcttatataacaaccgttgattgtcttctatcatagtaaaaacagccattgtgtaatggtaatagcagtcatacttaatttagatcatctcattataagaaaatatcacttaaacttgaaatttagtgaagcttcaaaaaatatacttttaaaaagtcaaataaggtcatcataatggattaacaaagacaattataatgataagataatagttgaatatgttattttaatatattaagatagattagaaaattatatatttttttaaaaaagcacattgcttaaatctactataaagatacaagaaacatacactaagaagagctggaaatccaatttatatgtgatgtcactcattcctgcaatcagtttgttattggtatccaagaaattttggaaaaaaaaggactttgtgtggtatcttgcatggaatggaggaccaaggttttaaataatgtgttatattattataatggaccccacatccatactgtttttgaatgttatgacaattataatggcaattatttgcctcaacagtagacattcaaactttaaaatttaataataattgtttaacagttgctataatgatattataatatcaaaggaaataacaggaaaataacatcattatctttcccttcactttccactgaataaaaaaaattaccttttggagtgtactataaattctagacaaaaatttagtataaaattttgaatatcgaaaaataatattttatttagaaaaaagtataagcaaaaataacgaccattatttatgttatatcaaacgattataatggttaacaatatattgaaatgtttattttttactcattaatgtgacaatgggtggtcgaaaccattataatgggccattacaagggttataataccattattgtataccttggggaggacaaaaaagaaggaaaataaaaagatttaataacttgcacatataactcaagaagacactcagctattgtgttgtattctcattgctctttttaattagcaccatgaattgtgccccaaaatgaagtgcagttaatgatgcaaacagatgtcattttttagtgttttttatggattaccacatcattgttcagaagaaaataaaaaaaaaataaaattaaaactccagccagaccgactgcctgggagaggataaaagtatcatgaaaggaatactcccttcccacttttaaatatgggtataggatatgcatggatggcttcacttcagcatcaaatgtgatcagtgcattaattcttgaatgaggtctcctcattcttttatgttaacattaatcctcaacggtcatttgaaaaactctatcctctagaagaaagtcttcaatatgtcaatctccatgggttgatttcgtgacacttgagctgataatatgggcttatagatctcatatatacaacttgaaaagcaaattcttgacaaatgataatgatgatcatttagaagttgaaagaatacactagattttctttcttttatttgggaggtgagatacagaaaaggaattttgtataccatggcaagtgcaaggtcaatcatttaggcagaatcaagttcggcaatgaaataagtataagccttgaagcaaaggaagcgagctgcttgaaggaggagatttcaattattgacactgaatggacaattgcatgataaagaaaaatggtgatgatgctgtaatttacatgttttttttggttggagtctcttcaaatttggagcattactatctcctaaaggtccaattcagccttaacatgaacatttttagaaaggagtgaggaacaaaatcttattagcacataagttgaacaagaggaatcagtggacagaagcgccatacaattatttgtttaagatatggctagaattcttaccatgtgtttcaaattgttataaccaagagttcgagtcccgatgggacatcccgcgggacaccgggatggggcatcctcccatgtgttaggataggactaaggattcaggtcccagcgagacgtcccgtaggacaccggaatgaaataccatctcatgcattgggataggaccgtctcgctagcatcccagcatccgattcaggacatcttgggacatcctctatctcaagtgttgggacggaccaagatagtggcacgtcccatcccatgaaaaaattaagatagccctgtcccacaggatttaaaaccttggataggactattctactatcgtcctagtatcccgattggtatgttttgggtcatccctataccaaatgttagaatgggacgggatgatagcgcatttgttccattgaaaaaatgagatagcccattcccatgagatttaaaaccttggtcataacaacaacttatgaagaaatgtgaatatccattccctccttaacatcaagactatgtcatccaacaaatgtaaaaaatccaaaataatatttctggggaatgtctaccaaggcagtggagaatttgattcctttaacaccaaattcttgggagatagggaaaaagtccctcaagttataaggtataacatcaactggtaagaaagaattagattcttgagggcaaaaataaacagctttagtcttttggagcaatgtatcttggagtcaatcctctagtgccatgatgtccaatttaaatgacttccaatttcttatcacctttttctaatgaagaccttggacattcataaaagaagatttcatagaccaaaacactgtaaaccagctacaaatttttcttgaagaatatcacattgtaaaccagaccacttgcactatcaactgtttttaacaattcttctatattgtaacactctcgtatctccacctattccacagaaaaaaatatatcatacttcctaatttaattttaatcttcatccaatgtttaagataacgaatagctatataaagattttatagtgccaaaaaaagtaagcagtgtgctccttcagcatcgatgtaggacacaatcataatacctttacaatttcctacattttgtccaccatcaatgttgtgtgaataatgtacatttctataaccttatattattatatagactacatctgctcacaaattgcattggctttatgagctactgaatcagctcactgtttgttgtgaattccacatgttaagtcactaaaagagcattcccttccatcatttaaatgccatcgtactagttttacacaaagaggttaacaattaaaaattaaggatcaattccctaatcaataaacctttggagaccaacaccaagcatcttttctaccataaatttaaaccagttctcctttgagtgaggtcccaaaacataggaggcatctattagcatggttctcagaaatctagcatctcaagtatacaaggcatggtgagtaacaactatattcgtgcttatttaataaagttaggggattcaaatggtcaaacaacagtatgaagaatcccatgttattattacaggtaagccctctaacatatcaaaattggtgagaatgacattgcaaatacactggagaagagggcagaggataaaatagtgaataacagaccttcaaatgtcatgaaaccacctatatgtaagattcatgaagtgaaagacaagagaacaagccattgttccataccaatacatttcaaatttatcattcaccatccttggagtttatcatcgcatctttgcaattattaaccacatctctaccttggatgtaagattcttcatttacacaccataaattaatcgcaaaaatagatataaataaacaaaataagaaattgacttccaagtagaagaatgtaaaaagataacggtttcactttgaaagggcataacttatagacttctttctcaaaatccaccacttttatggaattcaagaacatgactggagaccttgaacacatggtcctttccatatcaaaaaatggttaaatggagaaggaatgcatgaaaaactaggtgatttagcttcagcactctttttgaagtaatagtttcaacattagaatagatggaagaagggtacaagaatcccaaaggttcgtcagatataaggttgtcggtaaaggccccatcttagaatgcacttaacttgaactccataagttgcaatcctagggtaaacttatttcgaagttgaagagctaataatcacgaaactagggacaacctaaattcatgttattgcatgggtaaggattgtaaaagcttatgtactaagcaaatcaaatcacgatttctaattttggaaacaacaagttcttccatatccaattccatcaaattgcatttaggagaccagagccaagaaacaagtagggaaacagttcttcttttgtttggaaaattaaaatcagatcaatcattccatgcacccagaacaaaaagaatgcacgaaacattgacgattcctgatgctcatatgaaaggggcatggagaaattactcccaactaagcccaaattcaacaaaatccgaaactcacggccaattacaagagccaaaagaaaccccaattggagagatcaaagagaaacccagagagaaatcttcgaagaaaagaaacagatagagaaaaaggggcggggtgggaatcactttgagggtgcgggtggcgaattcgacgccgatggtggacttggagtcgaggaagaactcgttgcgggtgaagcgggagaggaggttggatttgccgacgcccgagtcgccgatcagcaccaccttgaacagatagtcgtactcctccgccggccccaaccctcgccgcgccatcgctgtgatctctctctctctctcttcgtcgagctccaacaaaagtccgcagcagtagttacggatgacaggtgatgatagggaaagaaagagagaaccatttttaatcatcctaacgaaccctgcccaaattccccaccttaaataaataaacagaaaaaataatgactgcaaatctaggcctccctttaccctttttggtaacgaggtaattcattttaccagttaaatgtattttatttttaaggtagcattatatcttcaaactatatgatttgacttttttatgatattaataatatttttgtattattatttaaaaattaattaggtataattttctcaattggttattgatttgaaaatttttaaagataatttttatttaaaaaaattaaagaaaacctcaagagaacgagagggatggcttagttgccatcgatagagaataatattttaaattaattagtagtaaaaattcaatctctcaatttttatacgatactatttaaaatttattaaaactatagaatgctaacacataaattacatttgttcgaagataggtagcttagataaaatacatgaagttaactataaattaaattttttagaatcgattacaatcaaaaattttgatttcactataatataattgaaatatggtgcttcttctttatcatattgtttcgattttaattcagacatgttatcttaaactctaatgccctccccctctctccccctcccctccccctctcgtacgtcgtacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggttatattactctgtagcccaaagatgtgtgtataaggaaatctggaagctctctatgagtatcagaagttcatccgaccaaactccatcatgttccatctgtacctcactgctacatgatctcactcctgaccaaggcatcttatgcttagtttcttatacattctaatgattgtacctatttttatttttaatttgagacttgtctcccctagtataatataatataatgtagtgttgtatacttgtaccataattcacattggataaccaatgctccctggccctcattgaggctttacatgcatggtactaccgaaatagtcgccgatgaaaatatataattcaaactcaactgattgttttaaaaaaataataaattttatttaaaatctaaacataatctatcgatctaaatatcataccatactgagcctagatagttaaaggtcagaatgagtcattggttaactcaatccatttgcaaccttattcagggcccgaaaaatagtttagagctaggaactcattgtgcccctctggaggaagaattgaatcacacataaggtcaaattaaagtcaaccacatggaagttagcagaggtcaaaatcccctacttttgcagttcttttcctcgtacatcactttggttgcatgaaactactcctcaggtccatcaaaccccatcctactcttcttttcccttacaaccataagactagttgctagttttgctcaaggtctaggctggcaagctgctttatgttcatggggtgcgccacatcagtgttgcccctgaaggcttcccttgccaatatgatgttcacagctgcagttgggtggaaggcatcccaaaacacatactgatctctatcagagcatggagtctggaagggaaggcaggtgatctgcccactgttgcgtccgatgccgcagcacccacggtcgaccacgctgaatcctgcaacattaaggaaagatatatacaagaattaatatttagttatataagaatgagattgcaatgttctgctaccttcttggatccaccctcactgtgacttatttggctgtatcttttgttctttatatgtgttgtttcattatcttcaatgaaatgtggtttggccttgcccaactctctctcattcttttttggtgttttttttcttaatcttctaattattacatatagcattttagttatgactgcagtaaaaaatatagaaaagggctaatgcccattttaaaataaaatcatgtacatatataagagattgctaaaagattttcatattattttgaatgaagaataaaagcttgggctatcttattattgaaggatttaaggaaactaaaagaccagacaatcaacacaaaccagtgccattcaaatggaagcacttaccataagatgtgggattactgaggatatctttgatcagccggaagttgtcaatgtatgtgaacttggcaccacggaggtttacattgaggttgtcaaccattaacttgacattgttgttgaagggaatcacaagattatcaacttcaggtgagcaatgacttgaaggattttgtgcaaggatgcttggaatacaggccattgatcctactccagcgatcacaaacctccgagctccaatgttgtataatctctacaagaaagcaaaacattgttctttttttttaaaaaaaattttgagaagatgcgttttcctatagattcatttcatgcgataactgaatgactacaagctgaactaaaacagaacgttttttcctttttctgatgagaactgaattagaacagtcaagtgaaacaaagaaaactaaaacaatcttaatcataagccaatttagcagttgccgaagtgcatctcgaaatatcttcaggttgcagtccacaaaccatatactaaaattatggatgttttcattgtctagctaagcttcccttgatcaaataagatttcacctctcttattattattttttttcttttagaaaaggcacagtgcaaagaacagtggcattaagaaattgaaaggttgatgctaagactgaaattaactatttcaagtagtcaattagtccttctctaacaaagattccattcaaagctctctctcctccccctcccccctcccccccccccccccccccctcccccctttttcttttgagcaaaatgctcattcaaagcttgcaaggctggctcattggccacattattgcatggtactcatgaagcaaggacatgagcttgcagccacatgattctttagcagttgctgtgcatttattgaatcaaagttgggtgatcaataaactgagtccttgattaatttcaaggttggcaaattacccatcacatggttactaatccaatctaaaacaatgggctctgtgacaaaccaacttacagtgagttggcgggtgtactgccggaccagaagatcagcaaactggtcggcattgtacacgtttcgtgtattatagttaggcatcagatagttgtttaggtagtcattgctccccattcccacaaagaagatgcagtgagctatggcattggcaacatgatcagctcctaagttcctggtgatctgatcaagcgtcgactcgaagttcctgatctgctgattgaatggtatcctccccacctgtgtcaccatttttggtgaaccatcacagagacatcagtgatgacgaatagtgtaatctagcatgcaagaaagctacctaattagatggttcttttagggatcaagagtgtagagggcttacaaagtttcgtccagtgatgtctaaaattccagcagcagccgaggcatagttaacgccatgaaggaggccttcaccagaagcttgggagtaaggtggaataagaggcagtccaagaagatcagctgcaagagaagacaaaggatgactcaataatttgatggtgtcataaacttagagctgagcaacaaattaataaggcacataacctgcacacttcatggcaatggcagggtaattgccatgccttggtagagatagattaacaataataggagaaaaatacatgaaaactggtgcacactgcaggcaccataagtgcatggagtgaatgatgagacgaggggacaataaatgcagtctacgaatgtattaaatggagaacttgctcttataccttggaattcgagactagaccttattttcctttgaccaatgtagtcatagaagatgaaaaattggtggatattagagagtattattaggcataaactcgaaaatttggtggaaattaattagcataaactcatcatacttcttattggcttaggctgctttttgttcataatttattatacataaatcaaccttagacatgaaccatggaggattcaaagcaaagtgtgttccaacaggatcaactttaaataaacaatggtaactaagtaccatactttaaatacaatgcgaggaaagagatcgagtaaagttagccctatgagatggagactaaaaagtttgatacaaaaatccaaggcacataaaagttaaaaaaagattttagtatttagtgtgaattatctaatctcgatattttatcaaaatctaaaagagttgggaagtagcttagtctagctaatattaattatagaacaagtttgatcactagttaataattaaaataagaaagttggtttcatcatgcatgagatttcaaataaaacagctgaatgggcatcctccaaattttgcacccgagcggtttgaaagccatccttcactcagggagaaaagaagttgtgaaaaagctttcggctcctcccaaagccccaccaccacccagggcttccacctacatgctttcatatcaacacttgtgacccccctgtgaatggtgtggtcatactgaaggcaagccaagtcacaaccattaaagacgagaggtttagaggactcgcctatctcatccacaatggtgtagccattggagaacctccctgtgggtccgccggcgaagtcgatgccataagggtagtagttggccttggcaaaggaggggatgttgttgttgttgccgttgtcaataagggagtctccaaacacgaacattgccggcaccaattcccttcggccattgccaccatctcctggtgcaactggtcctaccactctttgagctatagaaaaattagaaactgttgataaagctaggacaacatagaagaagaacatggagagtattggatagctaaaggttgccatgtgaactggatacaaggtggggaagaaaaggagatgggttgatatagaaaggggaagtggaaaaggatggtgggtagataagggtggtaatcaatgcattttaactgtgctcttacagaggagtaaatgggcatgtgggatggagtgcagagaaggtagagaacagtggtgtttttggtattttactggaaaaaaaaaaaatctatgacaggattgtgactagaggacgtacctcccatttaaggtccttggcaaggatttcctgtcgatttctttgaaagtgaacgataggcaagttccaagaaagaggttaaggttcttgaatgctgaatttgaatggtagtagcgtcataggctcgcaagttttagcctagaaagtggaacttgatcagagtttttttattagaaaaagggaaggaattaaggaaatctcgggtagattcttgtttgacctgacgaatccttcatgaatctagctttggctcgtagatgatcctcatctcatggatcaatgctggggtaactcaaaaaggtcattcaggtgttttgatccagtatcactttgcttcatcaagtggcagacgacaataattcaaaggagcaataagaatacactccaccagctgagggaattttttgagtcatctcagtaagatgaacaattatctacataatctttttccttttgattcatattttagatattggagaccagtataaagagttgaataacaagaagagcgaaatggctagtatctaatattatagctcaagtttcttaacgctttatttcggaagttgtatatgtaactttcgttctagggttctagtcatttgttactctgttactggatctcttttatatgtaacagaaaaaagaaaaacccttctggttcttgtggatcccaaatattgatcaccttactacacaaaatataaatattctcattatttgcttttttttagtgtaatttttgcttactacccaataaaaatatggataaaaagaaaagtagactagcctaacatgtccaccaaacaaagacacgcatcattacttatgcacccaaacatggatatgagccaaatctaactagatttgttttctcacagaatgagaatacactattaaaattacctataacaaatgttttattagaaaataatacctccaatatctaggctcgatacctcttaagtaacaaaatggctcatgcaatcattgagctataaccaaccagattgaaggattctcacttgatcgtagttaaatttttgggtgattatgaaaacaatcagtaaccatcattggactacttccatgaattatggcttaggcttggaacataataatcaccttgcaaaagattttgttagattacttggtttccggccattttttaaacttgaatgctgtggccatactcttaagaatatcattatgttttttctgaaaatatatgtggtgaatagaatctttaagaggcaccactcgttgaccacgtcttccggccctcggtctcctaaatattttcacgcggaaaccgtccagttgtcagagaggcagcagagacatggcagttgaagtgaattatgagctgctgttggaaacattgttgcaagtcaaacagaaataagtttagtcaaaggacaagttgacttcggggcccgccgttgtgttgcgggtccatgcatggatccaaaacttaggagcactattcctgggaaacgtgggtccaaatttactgacctcttcttataattgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggcggccacaggcggcggcgtgcgggacacgcgacccaggtgtgtggcccaatcgggtgcgtggcccagcccatgcgtgggcccacgcacgggtgcggtccaggcccgcatgcgcgggccagcccaggcccagaggccctacctcagccctgtgcctcggtccaccatggatcgggcggtccacggctgggcatgtggaccgtgtgggtatttttcacatatttcacgcggtccacgatactatttcgtggatcgaagcacgatcgaagggcccagggacgtcccgatcttgatccgacggtccagaaggttatttgactttgtttaggactcctaatctatctctaattaggtttaagccctttaaaagggcctgtgacgaacagtgaacagcagggattcgaatttttgctgatggtgccgcatggaacccgagaagagaagaaaaagaaaggcgtgaggccactgagagagaaggagcagggctcctagacagcggacgccagacatttcaggggttcagggggtcttccaagagagaggagagcttctgagaggaaaacttttagagagagagaattgggtgtacaaaggttgagggtgaggtctcctcttgtaaattttttttttcatagtgaagtttgcatatcccgtgaaagcgagtccttttgtggctaatccacgtattttgattattttgttttatttcttttttcttcctgctgcatcgcgtggtactgaaaaggtcttgggaagtggtgtcctggccagacatccatccaacaactagaaaagtaatttttaggatctggattgtcaagattagctactattgtgaagcttctccacctaaaaataatgtatcgatggagtaatgcatcatttgatgcattagttgagtttttgggaggagttaatttcaagtgctaaggaggagattcctaattccttttacagttgtcaaaaatatatatccgatttagggttaacatgtgttaaatataacatatgcaaatataattatgttgtctattgaaagttattgatcgatgcacagtgttgttctattttcaaattatctagatggaaggacagtgaagaaataagtataagaaaaaatatcccacacaagatgctaagatatttttcaatcaagtcaagattacaaaagttgtatatgtcacctaagattacagaacatataaagtggcactataataagagagtaaaagatggagaaatgagacatccagctggtacaccagcttgaaaatctttgatggtgaatatgttgaatttgcaaaaaatctgcataatattcgattggatatggcaatagatgggttcaatccatttagacaaatgagttctcagtatagtatttggtctgttattcttgttccatgtaattttcttcgatagttatgtatgaaacaactttacatctatctcttgttgttaataccaggaccatatagcctaggaatgagcattgatgtgttcttaaaatagctgattaaggatttgactgatttatggataaatggagctaaaacctttgacgcttatacaaagaataacttcagtttgcatgcagctataatatggatgataaatgacttttcaatatatggagatttgtttggttagtctattaaaaggtatatgatatatccaatatgttataaggatacatatagttgatacttgaatgaagcacaaaaaatgtgttatataagatatagaaggtttccaccacagggccataagtgatgcaaggatgtagctcatttggatgggactattgagaaaagagataagcctaaaccattgtctggtgcagagattttaaagatgctagaaaatctggatcaatagtcttttgggagcagaaatgtgagagctagatacaatcaatccaatactatttttaattggaggaaaaagagtattctttttgaattaccatattggaagactttgttaattcgtcgtaatcttgatgtgatgcatattgaaaaaaatatttatgaaaatattatggagacaataaagaacaatgctggaaaaataaagaatacattaagcagctgttatgatcaagttgaaatggatatcggacctgaattatatcccgttataagagagaataagatatacgtgcctgcagctcgatattatctatctaatgaagagctgatgttaataggtctcaaaatacctgatagatttgttttcaagttaagtaggtgtgtgagtgaaaagaagcaaaaattttttgatatgaagagttatgattattatatgtttatacagtgattattaccacttgcagtgagaaattttctatcaaaagaagtttgtgaacctctcatatcattaagctttttctttaaaaacttgtactcaaagacattaagtccagatgatcttgatcgtcttcagaatgaaattggcttaacactttataagctcaaaattatatttcctcctttattttttaatgtgatggtatatttagtcgtatatctcgctgaagaggcgaaagtagctggatctgtataatataagtggatgtattccattgaaaggtacatgaggaacctaaagttgatggtgagaaataaagcatggtccgaggggttgattgcagaatcatatattgctgatgaatgtttgatattctgcttaatgtatttgaaggaagatgaagtttaatcatccttttaggtacaatgataataatagttatcattctggtcatacctcaaaaatatttttttcactaggcaattcaatagaagctgtgaaattcaagactttaacacatgacgagtggcataaggtacaattatatatgctaaacaatattgttggtattaatagttttattgagtaagttttttatcaatcatatttttcaaatacttaattttttaaactgatgatatcttataaccattatagtaaaatttatatgtttgttgatttgtacataggttatataaaagcatgttgtcgagcataagtcatcctcaatttatagaaagatataatactgaattttctgattgatttcatagctatgtaagtattgaagggacaagttataagtgctagatatcattagatgcaccaatctaactattaaaatacaatatttcttaggtttataaattacatcgacaaaacaatatctctgatgatttcttttttttggctttagattcatcatttgctttcaagatgtaccatcgatttgatatcaatgattatcatttttatatattttcaagagatcaaagtatgggatctcaaagttcagaagtactttgtaggagagataataattctatgaaaaaaaatactataggatcattgatgagattaggagttgacttatcttggatcaaaatatgtatatctttttaagtgtgactgatataatgtccaacatctaatgtataaatataaaattgataagtttgaaattataagtgttaatattaataagcgtttaaatacaattgatccatttatcttggtccagtaagaagaacaaatattttatatctcagatcctaccaactctaattgggcagttgtaataaaaacaaaatcaatgaatgtccatagtatttctttgagtggagatgatacaaatgatgacaatacagaaattgaggagatctatcaagaagaagatgtagatgctggatacatcaatcaactattagataaagatgatcatgttgatatacttagtaaggatgacattgttggtgaggaagtgccactttcactggtcaagaagattgaagatcatattgctcgtccttctaaatttaaagatgacatatttgatagtaataatgaaatggggttggaggatgtagacaactataatcaagccaaaacacaaccataccttttagaatcagaataaatttattataattttttctgattactttaaataggtgtgcaattatgaaatcttatgctaattttatatctttgcttgtttattatgcaacaagtatgcaattaaagaatcatgaaaacttatatcagtttatgcctttggatttaactaactatttttgcatctttgcctcttgttatagaaatggctccaaaatataaagacatttcatgtactattctcatggcttggtaagatgaggacaatgcatcagtgagacaacaaggcagtacaggtctagcatgcaataggtagggacttacatccaattcaacaactaggtagagagctgtaggccttacatctagacctagaggtcaaacttctactgtacagccatcatttcaagttgtcatcagacacacatctagcatacaggtatttaactttatatgtcttactctaataaagagataaagttgatgccatttgctattttctttatttatagagaatatgtcatttgcaatctcctttgcaaagatgtttgaattctaggattcctattgtctatctctttttatattttaatttaattaattttgaggattggaggtgtcgattgtctgtcattttttgtgtatttttttaaaaaaatatatatctttatatgatacaataatttgagttattgagtatgtggcagccaagtgaggtttgagatcaaagtattatttattaattttaagatttatcctcttgctcacaacaataaaacaaactattttataagaaatcaaattaattctacaaaatttaggaaccgaaagaggtcatggttaataattctttttatattttcttggaccgtgcttggttggcttgtttttgctaggttatgttagtaatttagtatcaaacaaactatgactctcttgtatctgtgtatgtataaatggtgtgtacagactgcacatacacgaaaaggattttctcatgactacatattctgcattcacagttcaattatttttttgatttttgactttctcaaaccaacaaagtttactagaaattataaaagatggatgtggaacacagtaaacacaaaggtttaaaaaagacaagagcttaagccagccagacaatgtactataaagaaaaagaagtctgagtatgggacatacaaggcaattaatttagacttaataataaatagagacgagaacaatctagtcatagcaataccacctaaagactttattacttttataggaaagatgcaaagtacttggaccactatcttggcaaaattgtgagagattatacttatgctccaattggggtctagttgtctgctaagaaagagaaaaaatatgatatgagaagaaatcatggtaaaaaaaagtctatatcattaattatattgcttggttgttttgttctgtctacactattatgtttgtttgattaatgctacatccatttaagtttctatcatttatataagttctttatttatattatagaaatattttatggttagtccttcaaagttcaaaattttggaagaaaaggatgacatgatccctgatacaccagaggtaaagtaagaaaagttttgcagtctttgcttaatgagtatgggtgcaagctttcatcgatgaaagtataggctctatcgtgagtattacttgctattcaaaatagcagaggagcagtgagctacagtacctgacggcacctgacttatggtacaaatacattgaaaagtatgagaaagagaattttcaaatcaaatctaagaaggcatctaaaagtccatccaatcaagtaatcatatctaccactaggtcaaaattattttatcaaaaggagtatgaaatgataagctgttcaaattgttgtattacatcagctctgagtttacatgtgtctcttaatttttcctcataaacatatgatagatgaatcttgagactagtgagatggctaatccctgtgatgtatgaaggcaaagcatcgaataaaaaagaccgtattatgatattatgatccaaaattaaaggaagtatatgtgaaatttctttacttaatctttggttatgatctaaaatcgaaggaatcaaaatattgcatgcctgtactatattgtacttaaaagtatttcaatccaatatttcatttctttaaactagatcataacctattgttgcaagggtgcagaaggatgaaatagtcggatatgtatacatatcattgtttttttgacaaatgaaaatatgaaggtcattgcatttgcttgaatgatctattgacaagaacttataataatcaattgttaattctcatgcagtaaatttttctcatccaatttgtatgaaaaaagtcagatattgattcattctttattattatactttttaaattttttatcataattatatagtattttcatataaccatataagcagattttagtcaagttcttttcttttttgagtagtttattcctttatactttcaaatatatatttgatatagttacccttgaattttatttttagaaaaagttgaaggagtttggatcccaacccacacaagaaggtgagagacctttacatagggatgagatatatgcacgcatcttagggactcgaccatacttatcttgaagaggggctggttataagttaattataattgagacagcaaagaccattcacatatcatgtgaagagaaaatccatgaagaaaaaacatgtagatatgcaagcaaagttacagaagatgaaagtggtcgagggatagctaacagaaatggtaagtttaaaagagaggttgcaacacatgaaagaaatgatgcctcacttcttattgcacaaaagagttaaccctctatcaaatgaatcaaatgaagttgacaatgactagacagaagcaactagcgattataaagatgatcctatggaggtaattgaatgcatgatttttttttcatttttttttgtagtttggttggctaacatgatttagttacacactattggtgttatgtctctaatttaattgtcatttgttatttgctattcttttaggtgactgttaaatcttaatcgaaaactcattttttggtctgttagtttttgccattaacagtaacatataggagttaatttgtaatacccgatccatttgggccgtggatcaggcccaaaatctgagaggcccacaaatctcacaaaaaaaaaaatgaagaagactccctacgggagggtcgccgatcggctcctaatcggagttggaaaacaccccggagaggagtcaaacttcttcccctccgaccttatttaagaaggagatctcttctctccccgtcccatcaagaaatttagagaacgacgaggatcgtcagagttttctcgtggaagtccttcactgtgcttgccccaaattctcgtcggagatgtcatcggagctcaggtaaggcttcgacctttcttcctctccctctttcctttctctccaaggctttagacccttatcgatcatcgggatcgttgaaaaatctatgaaaagatgaacccctgttttgctctattcgatcgagccatcttcctctctttttcggccactgacgccgtcgtttgtggtatttcatccttaggtttggatctctacctctctatctgtcatcttcaggaggctttggccgccgacgaccagccaatgatcgaaaaacaaaaggaaaaggggcatgtcccttattttttgaatattttttaaaatcttccatcgatcgaactttgctgccggccatctcttgccccactgtcatcgatcgccactatcggaccttcgaccataccatcatgcctcaccagagcacaagccaccccttttttccccctcgtgtctctcctctgttcggctagggaaagaaagaagatgaaagaaagaagaaaagaagaagagaagaaaagaaaagaaaagaaaagaaagaaaaaaaggagaaaagaaaggaaaagaaaagaaaatgagagagtgttttctctctcttttctctctcctctctctattttttctctttaatttttctctagattctctctctactttctttctagaatttctctaggatctttttctttctctaattgcatcatggaccataggatgaacttgagatgaaaataagatgatctgagattgctttgaaattcatgcagtaggttggatctcagtctgatccttattcgaaatttataacatcgatcatggttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacctcatctaaaggatatgaagattctctcttcattttttttctctactttctctctctaaaatttttttctctaaaatcttctctctataaaaatcttatggactagtggagggtccagatacttaaacaaatctcaattttggctaatcctaggagaggtcttggatttatgttattaggatcgtttatccgtaattttttcatatataatttttatatttaatcttgatcatgtagagatgtaattattgtacaagaagatatggagcaaaatatcttaattttggattggtaaattaagaagctcatcgaattctgtatttagatcgatcatcgatagagataagaatttctatacatgatcaccattatatatgctatcattggtattgtatcattggttttgtattgttgaatccgtgatcgatgattttgctatgccagagacactgttatttgcttatatgatttttaagtgtgagtatggattatgtcaatatatataaattcatgattgatggcatgattatatgtgcatgatatatctattttgattacattgtaaattgaaattgttttaataaaatcaacatataacaattagataaaaaggatatggcttgaactagccttgttatgtaaaacagcctccacaggcttatacgtggaagaatttgatctgaggaagatcgtggatattttgatctgagaaagatcatagatattttaatctgagaaagatcatgaatatttcgattcgagaaagattataaaagtcgatctgataaagatcgtcacatgatcctggttagtccaaagctagaaaaaaagattaaagatcatgtgattctgaaaagagaaatagaagacaagacatgaaattaatgctgaataaaagtgtttcatccgttaacatatgatgatgcatcttttttgataagacaaataatttatggatatttacattattctggatattgatatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacaccccttcatttctctttttttttctcagagttataggaagctcatgattggctatggtttgaatttgcaagtgagcagatgaatagatagagtatcattgatacctgatcagataattaaaaatatttaatttataattatgtaagttttactaattattattgaaattagacattatagatgttgaggttgaatgaattatttttgaccttgcatattctttagggcttgctctaaggagtgtgcggccattacatatccgatccgaatgttgggttcgaggtatgatagagtagtatcagagcttagattataatcatttagtgactatgatataaatgattaggatatgatagaataatatcagaacctaggtttaagatcactagagattatgaagtgagatcaaaactttatgtaggatgtaacagagtgatatcagagaatatgacttatgtggtatcaaaactttaagatcactagggactgtgacataagtgatatcaaaacttcaggattataattaatggagtatgatagataatatcagagcttaacattatgatcattaaggatatgatagaatggtataaaagtttaggttatgattacttgagaatatgatttaagtggtatttgatcttaagattataattattcaaaattatgatcttagtgatatttgaacttgaggctatgatcatgaggaacaagatagatataaaagaaaagattcgataattagatttcgaatcaatagatactatgatgaaatttatgcataagtggcatatgataatagaattgacgagttatatcttagatttcaattagtagggttgacctaagtatgagaagtgttgatcttggaatgaagagagagatattgatgtgttgtgttgagtatactcaataattttagaatactaaatttatataggtggagattatgataatttttttaattttgatgttaattatctgatcattacaaattttggacttatcagaaggaagttagttaggatgtggtctaagaagaaattacatcatatgagagagaaatatttttaagcgttgaatctataagaggtcatatatgaaactcaatttagataaaaaaatatatttagattttatgagaatttgagatacacgtcttggtgaaatctttggttactcaaagtatcatatttagacctgatttcttgattttttaagttgcattgaattttaagtcaaaagttacttttctaagtcgatctaaggtattttgatattgttgtcaaattgaataaaaaaaattgatctaattagaatatgatatacacgttatgatcaaatctttaataatctttggattagattctttatttatgtaattcaaatcaaaattaaaatttctgagctgatctaaggtatcttattattaaattttggatgatttatataagtcttaacatataagggggataagattttgcatggatttatctattgatgctaagggttgtgataaagggagctttacaagaaataactaagttgattctacttacaaagatgttgacttgagttcctctagtttgttcaagttgaagttaatttttttgccaaaaaaaaaagattggtttgaaagcttgtctaaataatgataagataaatcgaaggttaactcaaattaattctagatatattggattcttgaggagtagtgaagcttatgtaatgagttcaaacatagaaggtggatgaagatttaattttgatgtgctatgcctaagagatagtaatgataaagaaacttaaaaattttatcgtaaattttatataaaatttaaaagtttgatctacctttgattgatttaacatgcaaggatatttttattcttgatagacttatataatttgataagttgagatcagagtgtacagtaaaagcatgatggtttaaaattgattagaaatattaattctttaaattaaaaaatattatgaaatacattagttgtaaataaggaagaattttattgaaaatgaaaggatactacagattttgatctaatatgatcatagccagataatttttgttaattgattattttattgtagataatgcctagaagaatcctagacatctcaagtttattgttaatagcttgatagtcctgttattagtgcaaacctaggatgtcttgacaccgatatcattttttcaaaatttaactttgtgactcgaaatgacataaaaggttaagattttcttaagatgaaagtctacctattaaaattattgaaaggtcaagaaaagaaagaaatcgatgattgtgaagagtgtccaatgttcgacctttttttatttttacatcataggtagtttaagataattatgaatatcgagtggaatgtattggaataaatacctatggtatgttaatacaagtataaaatattattgctttttgaaaaaaaatcaaaaaaaaaatcaaaaaaaaggggggacgatgaggtgagatatcaaataattttgtcataacaaggtcatgagaaataaatagtgtgtaagatattatcgaaagtgtgaaaatgacatgaagcatgtatattttttttaaaaaataataatatatctcaaacaacgtaacttaattttgaggatgaaattatttgaaagggagagaatgtaatatccagcccatttgggccttggaccaggctcaaaatctgagaggcccataaatctgacaaaaaaaaaataaagaagactcctgccgtagggagtcttcgtcctcctgactggcccctaatcggagtcggaaaacaccccggggaggagtcaaactccttcccctccggccctatttaaggaggagatctctcctctccccctcccattaagaaatttagggcaaaatgatgaggatcgttagagttttctcgcggaagcccttcaccgtgctcgccccaaattctcaccggagatgccactggagctcaggtaaggctccgacctttcttcctctctctctttcctttctctccatggctttagaccctccccgaccatcggaatcatcgaaaaatctatgaaaagatgaacccctattttgctctgtttggccagaccatcttcctctctttttcattcaccgatgccatcgtttgtggtgtcttatccttagatttggatccctacctctctacctgtcatcttcgagaggttttggctgtcggtgattggccaatgatcgaaaaataagaggaaaaggggcggatctcttattttttgaatattttttaaaatcttccaccgaccgaaccttactgctggccatcccttgccccactgttgtcaaccatcactgtcggaccttcgatcatgccgtcatgcctcaccagagcataagccacccatttttctcctctcatgtctctcctctgttcggttggggaaagaaagaagaggaaagaaagaagaaaagaagaagagaagaaaaagtaaagaaaagaaaaagaagaaaaaaaaagaaggaaaaggaaagaaaaaaagaaaagaaaaaaaatagagagagaattttctctctctttcctctctcctctctctactttctctctagaatttttctagtatctttctctctctctaattgcatcatggaccctaggatgaatttgagatgaaaataagatgatctgagattatttcaaaattcgtacaatagattggattccagaccgatctttattcaaaatttataacatcgatcatagttaatctatattgagtcatcctgatatgacctctgatgatctctatcatgattgcctcatctgaaggatatgaaaattctctctagtttctctctctaaaatttttttctctagaatcttctctctcttcatagattttctctttctataagtcttatggaccagtgaaaggtacaaatacttagacaaatctcaattttggctaatcctaagagagatcctggatttatgttattaagatcatttatccgtaattttttcatatataatttttatatttaatcttgatcatgtagagatgtaattattgtacaagaagatataaagcaaaatatcttgatttcagattggtagatgaaggagctcatcgaattctatatttagatcggtcaccaatagagataagaatccctgtatataattatcattatatatgctatcgttggttttgcattgttgaatttgtgatcgatgattttgctatgccggagacaccgttatttgcttatatgatttttaagcatgagtatgaattatgtaaatatatatgaattcatgattgatggcatgattatgtgtgcatggtatatctattttgattatattgtacattagaattgatttgatgaaatcaacatataataattagataaaaaagaatggcttgaactagctttgttatgtgaaacagcctccacaagcttatgcgtggaagaatttgatccgagaaagtttatggataatttgatctgagaaagatcatgggtattttgatccgagaagatcatagatattttgatctgagaaagattatgaatatttcgatctgagaaagatcataaaagtcaatccgataaagatcatcgcatgatcctggttagtccaaagtcagaaagaaaaatgttaaagatcatgtgattatgaaaagagaaatagaagacaagatatgaaattaatgctgtataaaagtgtttcatccgttaacatatgatgatgcatctcttttgataagacagataatttatggatgtttacattattctggatattgaatatgagattttatgttttattgcctatctttattttcagattatattattatattggtgtgatatagaaatttttactgagctgtaaagcttacactcctccatttctcttttttcctttcagagttacaggatgctcatgattgactatggtttggatttataggtgagcagatgagtagatagagtgtcattgatacctgatcagagaattaaaaaaatttaatttataattatataagttttactaattattattaaaattagacattatagatgttgaggttgaatgaattatttttggccttacatattctttaagacttgctctaaggagtgtgcgaccatcacgtattccactcggatattgaatttgaggcgtgacataattcttatatctttttttgtttttattttatttatatcaataaatatggcacaatatcaaacaaatatctttcagagcctccagacatatgaaaatggatttcgagttgtgtatgggtcactagttttgagctaattcaatgttttctttaattttagtttgatgaatagcaaccaacacaagtggtagatgtgttggcttgtgtaaaaaatacttagcaaagtacttggtaagatcaaagtgcacatgcatgtttggtgaatttgaatatgagttggtgaatgagaaactaataaacctttcattgttatgtttatgtagacttagatcttttggtacaaaagctttttggatagatatcaacctcaaatattatgatttttttactatatattatgacatgtgtatgcatgtgagatcatgcatgaatgttgtttgagcacttctaaattttaaagatatattttagtctattggtggatttggatatagacttgataactttattttttgaagatttctgaaattagtagtttataatatttgaagtttaatatttctccatccttatttgttgaaaagattatttatgtatgtcattaaattgaatgtttgtgtgtatggtttataatgttagaaatttttgtgctcgattgaaaattcaaaattaataaataagattttaaaaatattttaaaaatgattgatacgaaggtttctcaatataggaatatttttaaaaatacccatgaaaagccattggaatgggtacaaacatctttatagatttttaaaaatattacaaaatatttctataatttattaaaaaatatctctgttaattatagggaacattcttaatccattagcatcaaatcaatggagacttttagttaacattgttgtaagtctaagagaatatttgaaaaatattcctaaagagccgtagggatagtttgaaaaatatctctgttaattatgaagaacgttcttaatctattactatcaaatcaatgaagatatttagttaatattgttggaagtccaagaaactatttgaaaattttttttaaagagctgtagagatggataaataatatgattgaaactcgcatggaaaacaattgaacataacattccaaaagaccatttaggaatggtataagccattaccaaataattttactacaaacggttagaaaacgtgcctaatatatgtaaataatgttctcaattacttttaagcatacgagtatggctaacggacaaataatatttctagaagcttataagaatgatttacatattttttaatatatttttggaatgtttttaaagcctttattttttgtaatattgattggattaatttatgtaattttttccatgatcacataaataatataacatatgaatatatatggagctatacaaaaggtacatgagcactcctacaatttaatccaagtgaatagagtagaatattaaatatttaagtactaaaaattatatctataaagtagctaaggtgtaatataactatatggattttctccttcactaaggtgaacccctcacactagcaaccatgtataattccttcgctagcaaccaggaatccacttcataaaacatgttaggatagagatatgaactaggtctacaagcttataattgagttgaaaaataagataccttattgcatatttgaaatagagcataatggtttattaggtccagatgcaagtgatgattaggctatctaacgtggtaaccatcacaatggcataatatccacagtagaataggagcatgatcaaacatatagaattggagatccaaacaataacttgaaagattttcaaaaataattatttttactaaattattatgattaataattatttattttcataaaaaaatgcactaatagcttttgtaaaaattatcgctaatatgacctaggattctaataaagcatgatatcgtatgattaaggatttcatagaatagtactcaatgatcatttgaagatactagaataatgagttactaaattataggatatactttgtgagaaataaagaagctaactagttttatcctacttatcaagaagtttagtaacattatatggattttacatctccatgttagaccatattgctaatatgtgattaaagtggagtaggtcatgggtgattatgaacttgtattgttatattcccaataatgtatgtagtatatattatctatttttatagagtgatcgtaatgtgattttgattgatgttttttctaacaatttggataaaaaaaaatttggatttgattagagaaaagtttgggcttgagaattctggatgcattagatttgggtatctcaagtaaagcaagattgtgccacagagtcaaccctatgagctgcttggattgggaatgcaaagaacaactccaaaatcagtatcataaaagatataattctttctgtcatatttatttacgtataaaaatcatgagtaaagattcatgaattctgatgcaaatattatgatcccctgattttactactatggtttagagctatcctcgatattgtctttgcaaaaaataactagccttttatcttcttacaaagtcaagaatgcagcctttcctaagggctgggcttattaacatcgagggcgacttagttatagcggtcagatagattctgaacaatagatgcacatcttcttccgcaggatatttgaaaaatgatgagaaagtattatatatatatatattttttgatactaagtatgtttattagaagatgaatagttatctattatgataatttattttttaattgtattggatgtatttaagctaaattaatatgattgttgtattaaaaaaaatatcaaacctttccatcaccatcaatccattgtattatactggcaaaattcccttgtagccataggctagccattggcttcgggattctaaacaaaactatttatgcaaggcttaccgtccgaggaatcatccaacaacaatcccattcctcgtccctctttttctaatgcagcctgcttttatgaaacatatatcttgaatcatggctacttccactgaaaccaccaatttgattcacagttaccgcagtaccccatgtgacataccatagagtccaatccaacggtgaaagagctagcgctcacgaaataaaaacatgtccttacgctactccgccggcgcatcaaaccgcgagcaccatgcccgtggagtgtgggcggtgacggctctgataccctggaaagggactcttcctccgcaaacgagctagagagagcgagcgagcgagagagagagggaggaagcgcgatggcggaggagagctcggactcgtcgcaacgggggtttctggggaagcactacgaggagctgaaggagcactggaggaagaacttcgccttcttggactactacaagaagacgctgggccgcgcggagacgctacccaagtggaccgacgccgatgtggaggagttcattgcctctgatcccgtctacggcccccaggtatcgtcatcgatcgtttctcgatccgaccctgtctcttggattcttgattagggctctttgtggtcttggatttcgaatcggttatggcttgctttgcttccatggtctatgttgatgatcgctttgttcatcttggattaggttttgtattggatggatcttgatgggtcttgtcttgattcagttgttataaattttggggctttcagtcgatctggagtttctgcttgttttagagatttgatgctgctcgctgtggagcaagcggtgactttttgcccctcaattttcaaaggatcatttggttaagtcggatagttgttcattttctttggtcttggcgttttatttgggatttatctgagctttgctggagattttgatattctttttgataagtgtattgtttcacttgcctgcttgtattatcaacagttggatcttttgtttggaatggtcttatctatattgcattttttgcttctgcttgaagatcgaaactttaatgtggatagtcattgttctatattgccgtaaggaggctaatgctatcctgttctcttgtttgaaataaatgatctgtatataaaatttcaatgtgctgaattgctatttctttaggttatttgatggcaaccgagaaaatagttcctcggaagttcatactttgtttagtagagatgcgttgcttctttttgtgcaagtaggttttcccaaaatcgtattaaagatgatagcctgtggaaatgatagctagtacaaatcaatttcttcttgtaagtttttgaatttaagtcaaagaaatgaaatcatggtgatctttatgagtaattattcgtttcttctcctcttcttttcagcttcatgattgtaaatagtggttgcttttattagttttttccttctctcttgttatttctcaagctctggtttatcattgaaaaggtataacgaagttgcttgaaattcaaatgcttaagctttggttttatgctagtttcatatcattctcttattgattctacgtgacatatatagtatgtgattgcatcagtttggtattgacactttctactataatatatttgaaggtagaactaacttagtcattctagagcaatgtatccccttcacaaataaaatatgcttattgttatcagcaaagacgatacattaacttgctgaagtggaagaaattcataaagtcccagtttatttgactatgttcactaaaagaaatttatgcacaaacttgttttgtggattctctttttgctgttacaaatgtgttgtttacggtgcttgttgatttgaaagcctttttggacatgttgcttcttattattgctcattcttgaccagttattgtaatttgtggtaaaaagaaaaccattctttcctcataatcagggcctaaaaatttgattttgttttggtttttctagatttgtggagttttacttttggtggttttggaagttttgctcgtagtttttaagttgtggtcaaaaaacaaaaataaaaaaatagaagaacgttaacagaagccaagaaaatttgtcacatgccattttggagttcttttggtaactaggttctctgttcatgtagttttggcgatattaggttgaaagttaatattgcatataagtgaaacaagaaaccatacttgtaatctgtattttggattttgaacatgcccatgttcaattgttatgtatttaactttagttattcagaaattcatatatctagcaattgtaaagctttgtagtgtctggggtatccaatttttttttcttcatttcatagtaggacttaaggatataatgaatttgggcatttctttctcactttttgagcttaagttgctaatcaattaaatgcatgaggttatagaatatcataattatattgcaagaaaaatattattcctataaatgttttctacttaactgtttgcatttgtttttctaaagtattcagaggcctgacctgccaaggtctgtagttattatctttccctcttttaactcaagtaatggagagaaaagtcattgaaaaatgatgttctatggtctatgtacctaaaatgataaagaaattatcccattatgattgtggacaccaaagtgaagctcaaagaaaagcatctttatttgtcatggtcttgttttggttggaacaactgagtcaataatgcaaaacaactagatgaagtacacaagtcaggttatgattcacttaattgaactttaggaactccatcttagtcatataaggagtactgtctaatacacagacatacacactaaatttcaatatttaagcattgcatgttgtgcatttaattgtcgatacatgaaatgacacatataccattcctttctagcagaatagtcacattaaaatgagatagaaaaagatgcaatgttgtaaatgggcacatgaagatacaaaataaatgcttgattcttgtttgttcggcatattgctttcactggcttcatggtgccaaagttgtccattttaaccatgttctttcagtcattttgattttaattcattatttgaatgtttctcttctgccatttcgttgaatatatattttatatttgcaatctccctgattagttattgctaacactgtaaacatgaagtagaaagttcttaacatgcataggcacacaaataaggttgtttggttgtaagcatattttagatatctgaaaaatgggaacaaaagtaaaggtagaatatggtaaaaataacaaaaatgtgcagagtaagaataatataactagttgaaatattaggcccccatttaaatgatgccattttgtttgctttagcactgaatttctgactgcattttgatgtgaaatgtaaaattcatgatacactattaatattgacagtaaaggaaccaaacaagtgaaaatgatttcctaaatgaaactttgaacttgtttcatgtttcctgatctagtttttgttcattagagattgcattgatatcacatattccaatttttttgtcctaacttgtcatgttctggtttagagattacctttattttttactctcctctaaatttcaccttacccgttgataaaagaaaagcagaagaaaaaggaaaaggaaggagagtatatgacatcttttatccaaagaatcaaaaaactgtaatctaggaacagatagtgcagcaattaaattaccacaacatatggtaatttaccacaagaaataggactatgacaggtaatttaattgtgcactgtatatgactgataagttgtgctgggcaaaaaattaaagtcttggattaatatgcaatgtagaacatcttctgatgccttctattacaataccaaatctaagtgccatgcacactcatatttcatcagtgttggcgttttgagataataatgcaaaatgactgatcttataaactgcaaattttggtctttgacatccttactagtgcttgacacttttcttttaattaccaattctttgttttcttacttgcttttgcaagtacatggtgataactttaaaagttatctaggatgttaaaggcatatggtctcggtcatgcaattttgtatttccatgttgaagcagatcccactcttctttatccttttttcatcgagcttgctaaattctgcagtttcccttatacttctttgttgattatttgctttagttgttgtatattatcttgctgatatttgggtgaaagactagattcctaatggtgttctggaatggacctcttttccctttacagttgaaagctctaagggaatcaaggaagtatgcaattgttggggcactccttggtgcagcacatttaggaggagtttcctggaaatattcaaagagcccacatggtactgtagctttattactgtcatacttcttctatgattattttgtcattctgaataatcaactagttaaagcttctagttaaatgtatggaggctaggtcccatcataataactgttctagtttatattttgttgatctttgggcaaagcctggcctgagtgcagcacataaacaggtttagcaatcatatactatattttgtacaagttatgtgatgcctaaaacacaacgcaatatgacatataagctacataagcatggaccaggatcaaagtctctttgcaacttttaacagaactcctctgttctgatcaatctgcagtaatgctgagcattagcatttgaagataaacctttttgtttaagcttgtaagaccgatgaacatcaaaagtttggtaaatagacggaagaatattaatctcttttgaaaagaaaagtatggaatatattttatttccatatatcaggttgatgtaaacattatcagttatggtaaccataaccaaacaattcttatcacatctacatcaattggctaaaagaagacatcactgattattcctattagagctactttctcaacatcaacttttgcaagtccttcctgatgactgctattcatggtcacaggtcttctgtgttttctggctcttaaatgaaatccgggtcatgtgttctaccaggcccttggattttgtcacacttgctcattgtacatcagtcagctcacaaccacattgttgattgctgaaacttctatgccacttttaatgtactaatttcgtgtggtggtgtttgctgtatcctattaaggtacaaaggctttgaaagaatgtttcttttacagtgttatggggaaaaatctgtgacagtagtgaagcacaagacaacaaacttgtatttctttcttttcctcttccccttttcctcttcttcatcttcttcttctaaatggtgatacacttttcaagcaagattcttgtctactgggaatagtgattaccttctattccataacagtcctgtaaattataaagtattcttttttaacaataaaagttagtgcatagttcctgtgtttactctttaatgattattgcaggttttgttttggctaccgggtttggagccctatgtggtggtgtctttggatccgaagtcgcagaacactggaagcagctctacaagatcgataagcagggtgcgaatctcaggtttctctactggtgggaggacaaaacagtaggtcagtggtcttagttggcttatgtatactgatttttttttctttgctcaagtctttttaccaataagcagtactccgttcatatgtggttgcttcaagatatgatctactcaaaatcaggagttttatatccttaacaccaaacctaatagcaaccctttatgagttggattcaaattcttgacatcatatgttagagggtcttgccataatttctcaaatgtcaattgcggaggtaggatgccgcctaattggtcttgcaacaagtttaaactcatgagaccagaagatagggctgtgaattgatctgagatgcttgagcttgtctcatttgcagctcgaattatgcttgaatcacgcttgatttaaatataattcaaccaagctcgtgtccagttcgcaggctcaaaactatttttaagctgagcccaaaagtaactggctctatgaggaccagctcataaagctggttaaattattgtattttactgagtgatcatgtatttcacaatgtatttaatactttttagatttatattttatgcttaaatgttaactatttctagatctaattgtttgaattaataaaactttaattcaatcttgaagcgatctgaacccactagttgaagtggtgacccttgacctagttcctttccaactcgatcaatggtcctgggtttagatcattacaatgctcattcacgagcaggagcatgggccacaggtgtttgtggagggaggaacagatcgatggttggggatgggggttgggggttgggaatgataagtgatgagagttagagagagtgcaagtgagccagattttgctggccatgttggtggaggccgagcattaggtagctgggagaactggagggacccaaggagttgagaaagagggagagtggagaagaatggtgcaggttatatgttgtcttctggctatgatggaggagaagagagttgaatattgtattgaatgagccgtagtccaaatttccctaatttgaaccattaagtaattggataaaaaacagataattcactcaaaactggagcaatttgaatgaattgctggctaaactggtggtccttactgtcttgagatattggaacatcaaatatgtgaatttagctttaaaaatgcttgtcacataagaaattatgtgccttaatgtaaaaaaagaaaaggtgtccaacactgcttaaacacacagctagagtgtatctgcttgagtcaaatgtgggatgcccaacaagtttaaagctgggccatgcctgcagagaaataaaagtgccttgaacctgcaaaaaggacaataaagtgtgctgtttctgcaaagttcctaggaacagatgtttgatctctctctatcagccttttttttttggttatgttcttctctactttgccatttctgtatgcttgctgtcatgggaagctttatattgatgcagttccatgtagtcagcaagcactatttatgaatctgctaagggtccctctagtttgcaaagcccaagttggtgggtgacacaattctggtacattttatccactttgataggggataggatcccgcccactttccgagtggcaacgggtcatgtatgagtcgggtgggccaaaacctgtacctgttctgccatgaaaaaatccatatccgtccccatcctatatccattttgggtcgaatcaggtcgagtaaaataaaggacctgagttagattgggtctggtcgagtatacccgtttccttcagaatggattgggtcgggtcgggttgggtatcttcccttgcatggggtcgggtctctatgctgtatatattcttctttccatagaaaatgttcttgataccaaaaaaataactgaaatagtgaagcttgcttttgtggatcttgatgaagttcaaaattaaggagagaggccatgcctattgtctaatttttcatgtacaacattttgtaaaaccaaggaaacaatataatacctagcattggagacatgtcttaggtctctaggtcatcaaccaataacaactgtttaagtctgacacctctttatagagagtgatctaccgcaagtgttgtcctgcagaatttggcaacagtgaaacctttcaaggaaaaattatatgttaaattatcaaaaaaaagttgtggattagagggtgacaagaacagaagctgaaaaattagtttagtaaaagaacagtaagaggatatagaataattgggaaaacagtggttacaacagcaatacatgctcacaacggcactacccacttaaacataaaggctactacctacatccaaacacctggaaacaaaccatctgcaaggaggataaatcaactgttgcagagcaaaagataaccaccctccttaccaaaaaaagatttcacaaattatggggatatgcagatcggggaaattgaaataacaaccaaccctaaccctagaaaatgtaaaccctaaccctagattgaggaaggaagaatcatcaggatgagcagctggccagcgtcgaatggacggaagagtgcagccaagggagggatggttagacagaggagcagaagcttgcatgggaagggatggagtagtgcagcgttggacaaaagcatggcaagggatagaagcatggtgtcggtcgaagggatgatcctcaattcttcaaggcattgctacattggatggatggggaggaatggagaggaaagcatctaaggcaaaggagaagaggcgtgggggctgggtgggttggggaagaaatgattgaagtcgaatggctgtgggggccaaggggcagccgatttaagatttttatgttatccggtcaggttcgagatggggcatactattatctgcacctgacgtgtacatctttcgagtttattttctaacatccatacttattttggattttaatcaggtcggataaaactgcagatcaggttgggtcgggtacccggtgggttgggaaaaatttccacttctaattccctatgtcataaggtgttttgttactctttaaggtgtgaaggatataatacaaggctttctgttctttaatttttgcaattgaccatgtgtgcccttcaggtgttatgaattttcccttttgcttttacctgattagttggtcctttccgattgtgctccatgagatgcttagcctgttcttgttaaagtaattggtcgtatgaatcctgggtttactgatgaccatccatgtattcttttagtccttttgtcgttgaacctttatgctcttctgacagggaaccgaagaaattgatacttgctcacggtgcttggttcgtgctttcggatccgatgaaagtgaagcgttgattgcacttgtaatgaagaaagagagagagagagagagagagagagagagagagagagagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcccgaagaaaataacatgctgtgatgacaaaatcctaagaaaccatatattttgacgtcttgaagttctgttcttcattatgccgagtaaaggtaggcttgtcgccgaaaaagctatcataatttttacccatttggttaaagttttatgctgcaagacgtgctattacctttttaagctgttggcatctatttgtttgccttgacgtggtgaacaaatatcatttggtacaatggagaaggatcttgatcattaaattgtgcagccaggtgacttttgcgcttaatctttgggaacagtccgatggatttgttctcctaacagcctctctctctctctctcatatatatgctcggtaggccacgggagtaccagcccatgctgggctttgcaaagggtggagaaatattcgagacattgttttaaagctttttgcacccgattcttctttcacccccctagtctgctgagcgctctttgatacaccgttaccacttgatgatttctgctataattacgaggggtgatgagaactaatcatttcgcacgctgtagcaggcctatgtatcattttgtagggtaattccgggagaccttaaggatctaggtggctttttgtcccttattttttaagagatcagaggggctaatcccacctttctaccttatattcaccccgctcacgggagtttgcagcggtgataacatttgagcaagtgcttgatagtgatttagcttcagtttcattggctgataatgctggtgggatagattccctcgctaggagagtggacaacaattcctttctttgatttgtgtggtttgctctttcaaaacttttatacaaagatttagtgcaggcatgtgtacggtccgacaagttcttggatcctgaagcagggtgaaggattgcaaatagtgactcctagttggttcttgaataaatccggtttgttggtctcagttttgtatcagagtttccattctagtcattcaattaggagttctccaattgatttaatccgatcctattttttgtcttcacgagaattagaaaacaatatataatatgcaagaactcaatgcttacagaaaaacaagtttaacaattcctcaacttcaaagcggtagattggataacagagacccatagaaagacatcaaacaatctcttaacatcaaagcagtagagtgggataacagagacccacagaaagacatcaaaccatcttttaacccacagaaagacatcaaaccctctcaagagtcgctaggacacgaccaaatacaataactctccagtcataataatattaatacgtattgaaatggtcgcttaagggatcattccgagactacatacaaattggaggtattcacacctaaacaattttttttttgttttcaaagtccctccaaccttatagtcctcagtaggattagcccatgtctaagctcgtaaaactggaatagtcattctgtatggttagtggatatggaatgtcttccatcgctggagctgcagtaaaatgctcattttgctgtactatcattggggatacaccaaaatgcccattttgttgtaccatcattggagctacatcaaaatgcccattttgctccactatctgcatcgtacaaaataaatatataagcaaaaagacaaacaaacaaacaaccaaatggataataagaaaaaaactccatccaaaaacaatcattttaagcaacaggcaatgatgatttcaagatatgtggtatattttcttcctttttttttaaaggaaaatgtggtatattttcttgcagaaattcctcagcaacaaatcaattattcgaagcaattgctttaattttcatgattatataatttgactgttactcttgatgaaagatatatgcaaaaatcaaagaaagcttctacttctaccccaaaataaggaaatcttttacagtttttagtgagtgattgtttggaaaaaatagaactgaagtagatgtcttactaccttatttttaagggactggatttcctggaacattacctgcatctgttcatgagaaatttaattagagacatgtcagtttaagctaagatatgtcagaaaaaaacctttgtgaatgagttcccaacctttgtggcacgtacgtgatacgtccaaatttcgagatgcctttccagggcatgcagctcctccagtgtcatattgtcagaggctcccatatctccagacatgtacctgtcacccaagttctttgaactcatgcacaaactttgtcattaagttaagatcgtttgggttactttttacatttgttgatttatttgcaggagagctgtgaaggtttttggtgttgaggcaggcaaaaacggaacacatatttaagcatgcaaccacaacaagttctgacaccggatctagctcttgatagagtttattggtaaagaaaggtccattcaaccatccactaaactaggagaaggcttagtagctactgacattatagtggatatatagttattttgcaccttgtgtaattacttgttgttacttcgttataaattctaactctctcccaattcatgattacatgctggaaggaagcaataaattatgagttgcattctttgtgacaaattggcctagagcccactagctgcaatctctagtagaaacctgctacatgccctaagtaatttcttacaactaatgctgtagaggatttgcactcttcaaatcctggggcttattccggaggcatttggcttaagtaattctcattaatggtgctcccactgtagttcattaaaaaaaaaaaaagagaaaatattgtttgtataaatagataattttattctataagaaacacttcttttgagatatgaagaaattgcataatgagctagatagattgtataccaagccaaatggattcatgggaggggcaccaatttttttttttggtaccgtacatgttaagttagtgataacaaagtcaccaacttgttataccataatctaccataatttgggctaagtagggatgtcatggaaagaaaaatgctttgtacccctaggtatggcttgtcctagagttttgcaaactgccaggcctaaaagcaataaggcccttcatgaatgatctacccatggtgcacaaaaacctagtttggtgttcattcagggtaagccaagggtgcatggagccgtactcttttgtgcaccatgagggaaccttccaattaaggaagttgctaaaatgactaaaaaatgaaaagaggagacctgatggtgtgttaccattctgtctcatttaagcctaaatcatccaaagctatttaggggtgcgcctaggttccggcggcctaatgcgctaaggattgtgttgtaagtagatattggaaaaagaaggcccattaactgtaacagtttcatgtttttttctctcttaagaatcggctagggtttcattctttatcctattatgttcatccttctcggttcctcttatatatgtgtttgtatataaatgcacatagactgcatgttctatcactagaattagatcatttggttatttaggtgaacccctcttaatagtaggataatcgtttgttgttgttataacaatttaagatctcactcaaaaggactagtgggaagatattattttaaatttcttgatcctatataaatatctaagatctttctagtaaaaaactaatatgaaattaaatacatgctcacacgacagtctttttagattcttatatagaatcaaagaacctaaattataccttttggctagtctttttggatgaggtcctaggttgttacaattatagtgaaaattttattattacactaaaggatttcttcatataatatctattgcaagattaaagccaacttctcttcttattaaccaactaatataattacatttcattttaggaggacaataagctaataaaacacatggtatataagtaatggatttttttttaatttttattttttaaaagagagggagatatttgagatgcaccatttgggactcaaaaagagaaactctagttcttatatggagaggtatagcaattggtgcaagctttagttttgggtatgcaatacatagttataaatctatgtatacatgtacaatatacaaggtcgagaaattagaaataaggttgatcttgactagatggctgaggatcgacatcgatgctccaagatatttgatgtgtttgagtatctttaaaatatttattattaaaaaattatatgatttggagatccctacttatgatccaatagtcaaaaaatatgcattatttatattatttaaattatccattttaaccattagatgtataagtgatgtataggttagggatctccagactgtatgattttttgatagtaaatagtttagagatagtagataatattcagcagcttggatcattggtgctgggcccttggtcatttgttcaagttgattttatttggattctatatattaggtgtgtgtgtgtatatatagatatatataaatacacacacatacatacatacctatatacatatatatatgtatgcatgcatgcatacatatacacacattcacatgcatacatggaaatgcataagggctcacctcaaacacttctgtagtatgttgatctcttgctttagaactgatatctcctgtttaaaagattcctgaatatacgtagaaaatcttcaactgtgagagaagataattgtgaactagaaggcatagcttatatattaatgctatcatccaattaatttatgtaattgtgcatggtagtatggcatgttctatgtgctcatatagttatgacggttaaaaattgtgtacttaccatgcaagatgggattgcaccacctaaacccataggcatgaagaatggaaatcatgtattacagaagcctgtcatgcactagaaatattataaataatttatgtaagcacagataagctaactaaaagagggtaagtctttgtttttttagaagaaaaatcttctcttggcttcaggatgatagattgtcatcgtcgtagagggtgactctataacagtggtgtgctagctccaggggtgtatgcacgaggggtgtgctgctcatcccatctttcaggatatcataatttcattcattgagtgcactgttttgatcatcaggcatatctttcagaagatgaacactataacgaactggatggcaacatttataatagagcactttgaggatactctatggatggactcgaggttggccctacaactcctctaggacattttgctttctgatttttttggatgtatttatataaaaattttatgaataattcattttttatcggaaaaaaaaaaggatagatctttgatgcaatggtttacgtactctattgtgacttagattttatggatttaaaatacagaaatagcctctttgcaataggggctggggttgcatatgtttgaccctcatttgatcccacagtaacgagggccttgtgcattggaatgcccctttcgcagacaagttaactgagctagttgagcaaactgataatgttgttagcaaacttagtttaaatatgaaatatttgaaatttcctccacaacaccaaattttgctttttttttttcttttgaatctagttaagtaataagcatattgcctggaacaatgattttcttttttcttttttgaagtaatatgctgggagtgcctccttctcaagttgaacttgggacttggacagggctgccaaccggctgaaataagtctggttggcaacccccgattaagtactcaattaccattgaaatatatatgcacgtgaacaaatattgcatgcataggcatgatcacatgcatgaatgcgcacagatgtgcatgtacatatttatgcatagacacaagcaggcatgaacaaacacaaacacattgtcccagacattaaacagttacaagcggtgcagagaaattatagctctggagtgcgtgcaattttgtttcttattcacaggaaagtttgcttatggtcttctgtttttgtgctggacttgcatagcatattcaaggatttgaggtgtttaagttggccattcgtagtacctagcaaacagtaattttcttaatgaacttgctaagttccataattttgcttcaaaaaaaaaaaaaatcaaaataactagaggcatacaatagtaaattattatgattacagtgccaggatcgatgatgcccatttattggcaataaccttatggctaatgatttagcaagaagcaaatcttaatattatattaccaactccaacaagaagcaattcttagggttctcatatggtcaatgattcagtgggctgcatgccaaactagaagcgacgaacggtgagatcactctcctttagaccagtctagtgtaaaaatcctatactaagaaacaaaaagaagttgacatcctaaaaggacaaacaacagaagctaaatggtaatgcatctcccaaaagtaatgtttttacaaatttggtttcttagcccagcaccaacagaattcccactttataatttgtctatttataactcaatttaatcaacaaagccataatccaactctaaacccgtttatatgggattttcctaccatgcttttctgaatagcccacttttatatggcgatagtgaggagccttctgaaagagctgcgttgaataatgaagtgcctatatgaccctttttgttgctacatttgcctagcctatgatctttgcaccaaaccctgattgcaatcagtatatattccattaaagaaaagaatccgtaaattgaatccatttgtcacttaagctaatacatgctcatctagccatctatagttctgattaatagtataattttgttatgcttaattttgtgaagtccaaaagagtatgaaaaagacctgtgcttggatcacttcacccccttcagtttgagcttctccacttgtcttcctgtacctttcaatcaagccttccatagtccttacataattcaaaaatagaagctcagatgtatacttaaggcttgaaacagaagcaaggtaagttattttttactgatcatactgcatcacatatgagatgataaatataggtcaagggttggggccaagaaataaataacatataccccctggtggctagctcatagagcttgccatgtgtggagaagatgatgataccaatatcggcatcggttaacactgatagctccttcgccttcttgagcagccctgcccggcgtttgcagaacgtgacctgccggtggacggggttctcaatcctcctcatctgcaccttgccgcgtgccatctccgcagacaacctcccactagttttgactagcttcgaggttgttgcagtactgttctgagctctagctgtctctattgcactatagtgatgactctggggaggggctagatttcacataggagaacattcgagctagagcaatcagttaggccatctttatgcatcactggaatcacttgaacagtgatctctttgatctactttaatatatatgtaccttctggagcctgttgattagactaaggatccctcatggtactcatgcctatctggttctttggaggcatagcaaacttatggtcattcttaattatctaatgcattagtgggtcttttgcagatcctcaatgggcccttgcaagtcttcatgatacatataattcttggttaatgagttgcccatatggtgccataccagctttattctttgtataggcttgtatcttaatgcatgtcattcttttctttttttttttcttgagtgtaattgtgttctttttggtgagaaagctagatgactttgactaaataaactatatctttggagtcacatctcttcctctcgttcctctttctcatgctttgggtgcaagaatcctgtcaaatcaaaagggaggctctcattgatgggaatcctcctccacccaccagtgacagtctatagatccgacttcatcactagggtttttgggaggcccactttgtgtccttgggcaagaggagacattcccttgtgggatgcctcatggatgcttgtggtttaggatataaagcttgattagattccaattacttttcttaataaaatgggatggtaagggtatatcaaagcgcattggactttgataataaaagaaccttaagtgccctcatgcatggcctagttgaagatgattggccactcttgattttgttggttcccatcctttattatgtgccctcaagaaatgaaagctagtcagaatttgcaaataaactgaagctgagacatggaagatcatgtgtaataacatttatgtggcaggcacagttggtagaaaccaccagaaagcctgaaaattgcttcggtcttattcatcagatagtgtgtcttcttacttctgatcatatcctatcgctttgagctgataaagattaatttagggcattcatgcaatatttatagctagccactttgctatttagttagttacatgaacatggagcaatgtatgtccttctgaaatgattaagtaatttcttgctccaatttccgaaggaatcaggtcatcagtgaacattctttggacctcatataaggattccattttagccacatatgcacatactcattttgcgtgaactctcgtgtgtttttcatataaattaaatacataccacaaacctccaatgagtaactagaattgaattaagggactcggttcaaggaatgctcatttgagccaatgaaacttgggtctgctactttgcacctctcctcaattcatctcctgctatgtattgaatttacatattcaccaggaaacttcaatcacaaattaacttgatgaattcatttgaaagaaatcatcatttaagccagcgagacttgggtctgctaatttgtaagtctcttctggatgatctcctgagaagagattctggataggaacacaacaagtagcattcatattgtatttctcaacaacaacaaaaaaaaaagagagagagatagaaaaaggagtattttgcttgaagtcacattgaagtttcccacttgattcagtttgctaaattttttatttataggagtagatgcattcgactgattgctaaccattggcctacatattactggtgatcctgtaggacgtttgctacgatcaatcactgagtgatcctaaacctaatcatcctatccaagaaagctcattgtctgatagaggtgtatgaactataggatcttgcctttattcggcaaattttgaagaatggatcttgccttcttcttgaaggaaaaaggaaccaaaaaactgaaagtttatgtagtacaaggtacactggtgcaaccctagctggtagtagaatagatgcaagcttatcttcttcattgtaccttacaagattttaattcttttaaggaacctacaggcagcttcatttcgatagatgtatacattgacaaggaatcaaacctggggcacaaaatgcaaggatcctcatccaattcagatataatttcagaaaaactcgccaaactggatcgatcaagcccacaagcaaaaagcatcattatataattcttgcgcaagtgggaaaatgcaaaaagctccctcctaaagtgagctctgattggtctaaataatgtctatatccaaaggcgcatgacttggaattcctttagtgcgtactcctccaaccaagttgttcattgttggaaggaatgcgtcattgtgttccaagaacctgttcacagttaggtgtcgggttgagaggagatctaccttgtaagaggagacaagtgttgtgagatagggagaaagacatggggatcgttccctgggcacaaccaaatacccaagcagtgcaagagattctaggcgcatgcacgcttaaaaagggtcctccatctcctttagttggcatgtgttcatggggattccaaagtcctcagtatctattgggagctttgcaaaccttccaacatgcaagggtatttcttaaggcttcatggtacagatcgaacagttgagaccacatggtccaaaagctgaaagtatatggaaccttgtggataggatatatagcgtatgaactccaccgccaatgattcttggatgaccaacttaatttcaaatggttcatgcaattttaaagcacgcaactagagcgattatttttattgatgatgggagtactgctaccatatgggttcaaacttggaaactctctcggcacaaggactgcatgtaagagctaaagaagaggtgccactacttgatcctagttcccttagctagcaagtgacctttttcacttggtatttaagattcatgtatctctttgagcaattggggtaaaatcaaatttgtgctcaactttgattcaaatgtgaacttttctttgcttctaatgtgtaagcaattgttcactggagcttgtcccaataattacagctctttgcttaaaaatttaaggttctagatatgatttttgtatggctaaaaatttggatctggataattaatgagggagggtctctcatcctttttctctcttaaagaaaggataagaattctaaatatatcaattattatgataaagtgattttttacataggaattgtagggtttgaaatgtcatggtgacattgtttatgtcctacctgcaccatgataaattttattatcttaatgaattaagtggcagcctaaaagccgcctctctttttctcccaagaaaaagagagatagtggtagtgcaccatggcttcatttaactaggttgataaattttcttgataagaacacctttatttgattgtgattacttaacacctttcatctctttcttaagataagaaagaatattttgtatactttaatcacataactacttaattaatttgaattattatactaatagtatattttgtgactttgttgtcccacttttgcctaggtctctattgtcacccagtgaattgtttgagactctaaaatctaagcatttgtaatgaaggaatatagaatcaaagtatcctttaaagtttgcacatgtcattcatgactacatcaagtaatttttatttcttcaaaatgcaaatctatgaatggagaattataggtgtgccagatcgatcaagttgatagatagatacagttaatccaagaaataaatttggtgcctttagagaaaggacttgaatttagaatgaaaatttggtaaagaaagaaagcatcaagaggaaggaataactcaaagataaaataaccaacgaataacattgattataaataagaataattgaatataagtaattctttagggagatttaggtaaactgatcaaagtttaggatacataagtttctcatcaatattgttgattttctccaagatggaatgaaacatcacattagagaactattgattaggttaaagatgtaggatctgttgacattcattgtggtgcatagaagaggcataaaaactttttctatgttgggtggttaaatatccatgcatgcatagagagtataagagagtgaataaagccttctgtttttatgatacaatttgatagttaattcaagctgtaactattttttttagatggtttctcatcttgataactctctttctgattgttgatggtggttacacacatgaataacttcttagtatcctaatagctcctcttaaatagttaattctaatatttgaccacccaaatatgacgttttatatacgtgccaagtggccagccagatgctttctatatattgagataaaaataattattaattaaatattgattggtataataatattattcatttattatagttggttgatggtaacttaattcatagggataaacattacctccattgctcaataaaaataaatacttttgttgaaccagataaacataaggtatcatatactcaccaattataagaaatgttaagtcaaccagagaaataagttatcatatatgattgatccaaagatatttaagtttgccataaaatatagcccaggaaccatgtctagtaacatgcatgatcataggcatcattttatgtggattgatcatgcctatcaaccataacaagtctctactcacagtccccttattattgttgtcgagcatatatagtgatagattaatttttatatttctaccatgtttgaccatggtattggtcaatttaaagctttttaaactcaatggttaaaaatatataaacaccggccattctaaccacatattcattgtttttagtgcacgtgtctctaatatcaaatccaaaaaaaaaaaaaaaaagtagaaacataaattgatgcaagcgaccaattataataattattattggtcaaaataaatttcaatctataatttgtttgctcaactaattattttaggttgattagtcattttttataccttgaccttttgactaatttgaactgtatttgttatacatatttttcttagtcaattaacttttataaccaattggatcattgcgtcgcaaatatttgagtactttcagttgatcagccttttcaagccaactttattaattcactgctaattgcgaaatagatcacttaggctctttaagccaattcacataatttcctgagttatttttgcgatgatatgtagcaaatattttacaatttgtaatggcatttgataaatgtgattgcatgatgtcgtggggccatcaaggagagcatattaatatgatcacatatatcaaccattccatggcttccaactaattgctgttcctttagctaatgtgcagtcttgttgagaatttttggacactccttggccttgagaacctgccaaggcttcttcatgaggataaggagtttttttccccactatttctttcgacataaacttacctgctaaggatgattgtcatgctcaataaaattgtgattttgatattgtcatgtgatcattcccttcagaaagcttcagtttatttcattgccttggagcttttctttgacattttatcctataggtcccaccagatgtgccagaaacatttcagacacaaaatctaaagatcaaagatgtcgtagctagcatgccagatagatggtgtggataatcatgccaaataagtttggtgccttagtaaatagtaaaagaatttcaaagctcactagtgatagcaattgaataacaacaagaatacaaacccaagaatgcagaataaaaagataaaatatttcaagaacatctgacttaattagataaacaacctacatatgaacactaggtcaggaccaatatatgattcagcggattgggcccctctaagccctgctattactcccttttgttgatgttgttttttctctccatctattggtgcatggccaaaggtgatcattaaaagcacaccgctgtgaaggggtcgtcctttggtgccgaggagaacattaaagacccgcttcgatggctgcagctctgagagctggggtgaaaatagtataaaaaatatccatccgggtttaattttgcattcgaatcaatatagatatcgataaaaatttaaaaatctaattagtatcggtatttatatttatatccatcgaaaaaaaaatagatatggatatgcatagacaactatctgatccgtattcgaatatttgaatctacctacaactttatataattttataaaatatttattaatttttttaaaaaatatacaaccatatagacatgatattaacttgatttatcatctattcgataatacgtttgattctgtagtcaaaaatatatttttgtataatgaagtttaggggtattaacaatcgagtgatttaagtttcatatttgtcaatttgatcaataatatggcaagatcgatcaaaataaaaaaaacagatagacggatctcaatgccgtttgcccatgatcatcatgtgaccacacctggcccactaaacaatcatacatagcttctgattttgatcatacatcacctctgatccgacccttgtcgacactatcttcctctcctactacgccactctcgatgctctccccttcctctaccacttgcccctcttcaacttgagtgccctccacagctcggataggtcaagcctagagaagaaggatattagattgaaggtgtggagggcttggtctggctcctccaacttccaaaactttctatcctctgcctctgccacctctgcggtctttgccgcatggcacttcaccactgtcatttgctcctcctcgagagccccttcttgaaccaaggatcgcaaaggatcccatcgatggtgatccttgtttcgggattcaggtctaggatccagccaatgagatgtcggagcttcggcgaggtcctcttggggcatcggtactccctccaatagatcttgcagttcatcgccatcaaattgaggtcattgaatagtagatacccaacattaaggacgtaaagaataatgctgtaggaccagatgtcgatcttggtgccgttgtagctcttcttagcaagcatctcgggcatgacgtatgctagagtctcgcagagggtgtggaggaggccatcgccggggatctattcggggaatgtggagaggccaaagtcagagactttgaggtggttggcattatcgaggaggaggttctttggcttgaggtcccagtggtagatgccgcgtgcatggcagtatttgatggcggagattcgttggcagaagtagcattgagagaggtcctcaagagatggcctcgagcaatgcatgcatagagcttgctattgcaggcgagcttgaggacgaagtagatcttggagcgggaagcgaggaccttaaggaagtgaaggatgtgggggtgatggaagtggcgcattatggcgatcttgcggatgacattgtgggcatagccgcccttggctatgcggcccttggggatggccttgagagcgatgctttgattagagtagaggttgtgagcgagggctaggtcggaggttacgtatgatcaagatcagcggccgcatataattgtttaatgagccacgtgcagtcacgtgatagttatggacaaatggtgttgaactccatcttcctattttctagattttgattgatctcgccacattattagccaaattggcaaacatgaaatttggatcacttgattgctaatatctctgaacttcattatacaaaagtacttttttttcctaaaatttaattatctaacttacactacaacaaaacaagatattagcataaaaaaaaattcatcgctaataactaattttcatcgttaatatttatcataaataatcgcgacattgataattttttacgatgaaaaaaaattttcatcgcaaataattgatattaccgatgaaaaatttttatcgttaaaaaagttattttattgcaaaactatttacgataaaaaattttaatcataaaaaagataatttatgatgaaattaattatttacgatgaattttattcatcgctattaatttaattaaattttttataaaaatcaaatttaaaaaagcattagtggctaaaatttttcatcgcaaatatcataatttctgacataaatttttatcactaataaatattaaattaataacgataaaaatattttcatcactattaatttaaataaattttttataaaaataaaatttaaaaaaattagtgacataaatttttcatcgcaaatatggttatttacgatgaaaatatttttatcgctattaatttaattaaaaatttttatgaaaatcaaatttagaaaaatattagtgatataaattttttatcataaatatcattatttatgatgaaaatatttttatcgctattaatttaattaaaaaaaattataaaaatcaaatttaaaaaatattagtgatgtaaattttacatctcaaatatctcaatttttgacataaatttttatcgataataaatttttaattatttatgataaaaatatttttatcattattaatttaatataaaattttaatatttataaatttattaaaaaattatttacaaccaatttttttatcgctaatatattttttaacgaccaatatttcatcgaaaataattctatcgctaataatatataaatattttttaaaaataatttataaatatatatatttaatttatatttataataccttttataaattaaaaattaaaaataaaaaaattatataataaatttataaataaattttattattttattatattaaattaaaattacaagagacctaaaataaaaataaaaagctacacaaataggtcgtcaagtgccagcatctgcggaaggagaacgggttggggaagaagaacgttcggatgagctcagaccgatctattgttgcctcatcagctgcatcatctgctctatctgcgtaatccattccatcatctgaatttagagctgctggtactcatcgacacgtgcagtcaatttatcagcttgctgcttagcctgcctatgcatctccaccagccgagcttcgcaggtagcatagatgtcagtcctgaatgagtgtgaggatgaggtagcagtgatcccatgccctaaactcctaacataacaggatctcataccaagcacctgatcacaactctcgccatctgtgggtgcgatcgagccctctggattggctgggatctgatgtctatcatacggtcttgaaaattaaatttatagctattttaatttcgtactaaaaatcaaactgtgaatgaaaaaaataattaaaaaaacttataaagagctcctagcactccgtcattcactcttttgatcgtcgctggtggatccactggtagatatcgatcataccagaaagctcgccactctcagtatctctctgtaatttgagaataattaattaaaaaaattttaattagctagagaattatatactaattaaaaattacttaccatctgctccatgtgacgagtgaacgatctcgaaccccacaatgcggtatggtctgtctcgtccgattcatgacattctggacacatcttctctatacagttagcaatcaaattagtaggtaacaaattgaatttaaaaataaatgattcaattattaaattaaaaaaaaattggatgtataatctgatatgccggatccttgtaatatcggtatatgatagtccaatcatccatagtgatgctgtcatagggccgctgtcgcattgcctccacctcatgatcctgcatcacatggtaccaatgctgatagatgtggtggcgatactccttgaaatacaaagataaatgagcatctacagctcgctgcatgcgatcctcctaaaaatcaataatatcaaatacaccctatcaataacaaatattagaaaaatactatactaattaaatattcacagtatatttattttacctataattgagtgtaaaaaaattttctctgagccaatacaatgtgacaccaattgaaaagcgtcacggggcataactgcagcatatgatgcccagcttgatctgccacagctcgtaccatctcctaatgagcttggtgtagccggatggtatctcgatacggagacactatctcgggtactcgcatctccaatactctaaagcgaggttctttgatggacctcaccctcacctcactaccggtggagactggcctgaaacaataataaataaatcattagtatgatagctatctaaataaaaaaaaataaattttattatataaaaagtataataatatcactgggatccgccttattgggacctgccagtgtaggatcctttgacgacggagctgatgcggcagtggaaatcgatgaagacgcctcagcctccgagatagactgcgaacgcaaacgtcgtcatctttctcctggtgccatacctacaattcttgacatataaatgaatataatattaaataataataataaaaaataaattatattctaatgaatagaattaaatcgcataccattattgcaagaaaagattgaacaaagaatatagatctactcatcaatattcgtatcttccttgatgtgtagatcctcctttgaatcataataatcgatatatgtgtcgtcttctatctcatcgtcatttatgaactgatcatcgtcctctgactcatcaagattaaatacaaaatcagcttcaactttgttagacggtagattagccctatttaaaggagtcattacaagttcttcatcaacaagaagctcggctaatatttgttcttcttgctgaaaagcttcctcttcatgtaaatttgaattttcatccatctctaatcgggttggtatgtcatatacacctctagatattattttttgtacgatatgtcaattacttcgatactttagatccttcaaatatattactaaatattattttcttaaatattttttttctaaacgagctccggactcggcttcccatagcccccgctcccacggcgccggcgtcgtcacacaccccgcgccgctcagactcgacctctgcgacccccgttcccgcgtcgccaccaccgtcacccacccctcgcgagccaccccccgtggcaccgctgccctctccaaccccccgcgatccggatcccaatttagattctgatcgaacttcgatctggatcccaatccgaattgggatcttgatccggatcctgacctcgatccaattcagatcgtgatccaaattttatttttattaatcaaataataaaatatttgattaatattttatttttttatttttttttctatttttctccctcgtttctctcttcccttcctccctccctaccatcacccacccctccgcgatcgcctccgtccctgccgtcacccacccctccctgacggacctgctccctgccgtcacccacccttccttggcagaccccctccccggccgacccactccgcggtcctgtggcaccgctgtgtcatggccgacccccttcccgaccgcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaattatataaatagttaatttatgattttttctccaaaaaaattatgtacataaaaaatataattttgatgaaaaatttaatttacatcgctaataattgttataagaacagctcttcaacttccgcaatggaataagcaccataggagatcgatagttttgaggtcttcgatctccaagaagctcatcttcttcttggagtccctgttctggaagtcggagtacttgaatgtcgcgatgattctgagatcgcgagagaaatctaccgagactgagtcataaattatcgaatacttacgatgaaaatattgataaaataagaattatcttttgtattgcgtctatctcataaagctatatctcagcaaattaaccttcgccgacaccgtccctacacaaatagcaagtcaaatacttccatcgcatgacagaagtgttgggtggatgtctggccaggatactacctctcaagatcttttcgatatcgcacgatgcagcaaaaagaaagaaaataaaatagaaaataatcaaaatacatggatcagccaaaaaagagctcgcctccacggggcatacaaacttcactataaaaaaaatttacaagaggagatctcaccctcaaccctcgtatacccaatttctccctcatagaaagttcttcctcacaaaagctctctctctagaaagacctctctgaatccccgaagtaactgctgtccactgtccaggagctctactccttctctttgcagcgtcttcgtgtctctctctcttcacggatgttcaggctccttcacagctgctcaaagttatccgcgcaccacatcaaaagtcaggccacaccataacccttctgttcacggtcacagccttttaaaggcttaaaatctatattagaatatgattaggagtcctaagatcaaccaaaaaccttctcagatcgttggatctcgatcgaaagctccctagaccgtcggatcgcgcacaaagacctctgaaccacgcatggaccgcgacttcagtccacgtgatcccatagaccaccagcaccgcatggtccatggtggaccgtgcgagcactgggctggcccacccacatacattgggccggcccatgtgcttacccgagttaggcctgcccgcgcctgggccgcatgcgcgcttgggcccgaccgtgcctgggtcggcgcacctgtgctgggcccatttgtgcactgggccatgtgcggctgcgtgctaggcgcgtctctgtcgggccaaggcacgctccgctagtcaccaccgtctcgtgcatcgtgccaccacttcgatcgctcgtatctcctccgttcgaactccgtttgggatgatcttgatctcgttggactccattttttgtcgcgaacctcactgtaagctcaatatggatcgaatctcgaagcatcaaatcctaacaagaagaacacaatttcaaaatatatattgatattgtaaaaatctgtagaatattattctctcgggcttctgtttcactgatttatagaaagaaagtaataatttcttgcaaaacaagaagaaaggggagagcatttaaactcaaattcaaagacaggatctaagccttaagagtaaacttaccttatcatgccaccatatgaataacttttttgtggatcatattttaacatataaagatcttgtatcatctcttttctatatttttggacagatataaggtctttgtactttgtgatctctggtcagtccatagaacaataacctacacaaaattgagcaacgagacagatttagaaaaacttgaagatgattaatataaaaaagcatgcctcataaactataaaatagactgtttacaaataaaaataaaaataatacatatttataataaatttttttcatcgtaaaaatagtttatttataataaaaaaatttcatcgcaaataataatcaatttttgatttttttaactattggcaacgaaataagtttcattgcgaataattttgtatttatgatgaaaataatattttcgtcataaaaaaagtcatttacgataaaaaattttcatcgcaaataatctgtaatttttatttttttaatttaatttttttagctatttatgatgaaaatattttcattgtaaataactctatttactatgaaaatagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaactattctgtaatttttaaattttttaaattttttatttttttcaaaatattgatgatcaaaatatttttaatgtaaataatctattatttatgatgaaaatcgattttcattacaaataatcaactatttacgatgaaatattttcatcgcaaataatctatagtttttgaaatattttaaatttctcattttttttctagatattgacgatgaaatattttcgttgggaattaggttattgccgacgaaaaaatatttttcatcataaataattaaattatttacgacgaaaatattttcatcgtgagtattttaaaatttaaaattaaaataaataatatattatttacgataaaatatttatcataaataatttgtatttatgatgaatttttttcatcatggtgaactatttgcgacgaaaatatatttttatcataaatattttattatttatgataaatttaatttttcatcataaatacaattattgatgatgaaaattatttacgttgcgaataattccgccacaaatttttttttttttatagtattatatcaataattatattcatacttccagaattcaaattatatccgtatttaattaaattaaatatagatataattttttacatctaaataatatctatatttatattatattcatcagataaaataaatatgaatatgaatatattggtatccaatcgatatcaatatcgagggccatcgagctgcatgaaagatgcagattttctcctacgaatgtacgtacgtaactgttatatccacacttcttgaaaaaaaaaaaccagcatctttttttttttttaaagggtgaaagtataatgttcgtcaggaatgttatctgcccattcacatatttgtagcttttccactctgcggcgttagtttgcgctaaccttttcggttgaagaacaaggatatgattttaatgtgcatgtcagcaaaaacttgcaatctaagacttaatgcgaagctgcggctttcagggtcttcatcgatcttctgtgccatgccctatcttggaagggtttatgaagaaagtaaagctattacgcatagcaagtaaaaacattatttgcttatcttttctcatgctacagcacaagtaaaccaatgcaacatacatgcttcaaggggctgcctcaactagaccaccatcagggaaaacattcagcagaaaacaatagcaactcaacattaaagctgctgaacttagtacttaatttggcatttagaataattatatagaaacttgtaatcaaatatgaaaaccatccacctttatgaaacgacatttcctgtattaacttaaaaaggaactaccaaaaaaatttacaatctagagagcagaagatgaggcaaactgaacgagattgaccatttgtttgccgcaccatgcttttctgagttctaatatatctgtttatgtccaaggaagtttctagcatttcggatctccttcacgtttgcccagagagcagggacctgaggaagcttttacctaaattttgctcaatgtatatatgatctttcctttcagcaagcacatttttgtccacatctgcagcttcgtcggacactgcatgttcatgaaattgggaaaaaaaagaagaaatggagttctcaaaagatcccttggaccaaatctgtgaaggtaaaaaggaagtgataaagaaaaagaagataaatgacagtggcaaattaaatgctaaagcgccatgctaattccagttcatataaacacttctttcaccaccttcacctcaagagctaaagaaaagatgggcatgcttagaggactggtagttgataatcttcaataagatccagtgacacaagtctttgtaggcataaatgtaagtgacaaaaaagaaaaaaatgaatgggctgagtattaaaataaacaccttgccacaaattggagttcataacaaagtaaaaatgtcaaggaaaaactagttgaattttattagacgatataacaacacagttcgtcaacattgttcaatagaaacaacaggcaatagggtataaatacaagcacattagcagctagatacagacaatattctgtgataccctaaaaatccttttggattaataaaacatgactatcaaatcaatgtgcaatttaaagcaagatgactgtgtcacatcccagacattgacaaataattaattggccccggcccaaattatgcggatgtgatcctcattcagggaatgtgtccacgttcataggaatgagcagctgtggtgcataaacagaaaatatctttacggggaagtaaaaaatacatcattcttttgaataaggtatttgtcctcatattgctagtttgtgatattattcaaggcctttcttggtcatttcttgtctctgggcctgaatcctctccttcaagatcttactcttttcaaaattagccttccgtttcaaagctttctgaaacaaatcaagagatacaaaagaggcattacataaagagacgcattggggaaaaaaaaaaaggtagctcagtgcacaaggcttcagccacggtaaggtctgaagagactccagccctacccctgcatatggagagactgtttccatatttcaaactgtcacaatgggcaactttagcattgcagctaggcttgccctctaaaagaggtatgctataaataaagaaatttagcaaatttgagatgattactgtagtagcagatggaaaaggaaggaaacccacttcctcacggaaacagcggtccagctttatcttcagctcagtacattgcccaaagaattttgcaataggatggtctatatggcacttttgaaactgttcaatgatctaaaataacaaaaagcaaattagcaaacccagagttacaaatttctagatgaagggatagaaagaacacattagcgatggaggaaatggcaagagaatatataaaacaccatcaactgatctcatgagtttaaaaacagggacctaaaaaatagatagtcattgctaatttcaaacaaaaactttatcctttttttttatatatatattgatggggaaaagtcatttggttaattctaaaaatcatgagtacttggcttgcaaataattattttgtactaatattaacttgttttacattattttacctgatagcaagcatttaatgaccacagacaagcataaaatgcacaggcatcaggaaccaaaagaaatggaaaaaaaaatgaaaaggatggcactaatataacacaatatgaagccaataaggagatgaactacctctgcacacatcggatgcctatgcaaagtcagaggagggtgcatttcctgcaaaattccaacattctaaattaagaatgatgcgaaaaaactatagaaactgaacccaatcatattataattagttgcatttttgcagatgaatgcggttaagtaacttgaaagtacaagaaacgcattagatgcagccatttatattaaggctggtaaaatttaattttggataaaaaaaatgatgggacaaggctaacagaaagactttgatattatcacaattgccacattactttcctgcaccaatttccaagcttaagggccacatgaatgtgaagtttccctacactatccatcctcaattgctatgttagagaagcacttcaatggtcaatgtaaatatatatgtcttcacatctaatgtcattattctgtagaatatgcaagaccttaagtgagacacattctctgaaacctggactagaagttttgcactataattgctactaaaccttgaaactaggccaagcacggtccaaacaattggccagcctatgaatcaaagaagcttctgagggttgcacaaaattcagcccagttatgcaagaccagatcaaaacataatccttctagtttaatttaacaggaacccttatgtcatcgattggaaccaactgagaaaacagccaaaatatgaagattaccttatttgatccatttactgacaaaacaacgtatcagctctaaatccagtctgctcaattaagatggatcatatcatgccaattcctaatctgtatccagtcatgctcaccatacaaatacattcatttgttcccatacaacatgatttactagcaccacatcaaacatatcttataaattgaaaaaaatattttcaggcataccaacagacataagtcctaatttcagttgacaaatgatattcatgataatatcaacataacaatatttatacaagcagaaacagtttagggatccttcccctgttgctattatgctgacaatggcgtaaggccatacaatagcagactcatggtccaaataagggatgaaatgatcaaaatggaaggaaaaattgtcgcttattcaaaaatgaaacagggaaaggataatacaactccatgtaaatcgatggaagtccattctatcactccatctgacaaatataatttccaaaaatgatccaccagagccattcactagcctaaattttgcttgagaaatgtgtcagggatctcaccaccagggttcacatgaagaccttccccagattgaaagtgatgccaaccagctcaactaagactggttggccttcattaggctacattttcttctttaaaatttctaatagatagttacacaattgtgaaaaaacactgaaaagaaaagttattgaccagttcttgatctaagtatataaggtgtttgtttagtccagcaatatatgaaaccttctggcaaaaacaaactatctaccaccgatagcatatacaaaaaataggttgtgaaggaaattcatcactagcaaaattggtcaatatgaaatgtcatgagaaagagtgcaagtcttcagaatttagaattagttactttcttaaatactgccttgatgattgaggtatcttgttaggagtcactctatgcacggttcaaatatcttaattaagtttaatatgaaaaaaatagctattcaattttatcaaattcaatacaatatagtgctgtttgatgtcaattcatgacttatattattaaagaaatacaagggtccattcaaactcccctttttcctggtcaacatcaacattcattttcaataaatatttaagaagtagggtacaacttcgacatatgcacattgttattcattttcacattttattattgggtaatgatacaagtatccatacaagaatattgaaattattatccacatttggtaaaaatggacatggatgagaattggcaagaggaatagcaatgtccagtgcaaacagatacaaacaaagagtatataagaggaacacccaaatgcagtgctaccaactatgcattgtcaaagggtctagtacttggattatcgaggagcctatccctattgtatctttcttgtgggctctaacttcttaagttgtcgacacaagggtccaaaggtttaggttcaaaaggagatggcaaaatatgaaagaagcaattctagaaatttaatagtgatcaggtcttgatcaagttaggtgcattgtatgcgtataaaggcattcatctttatattcataacctacaaagcataattgcatctgtacttaatgcaagaccgatatgcaatccacatgtatgggatgtggacctaatgtgctagaatatgctacatattaactcaaaacaaccacatgtcatctaccatcaaaataaaggacagatgtgtgaatttgcacatttaagcatacatagaagttttctggatttgtcttatagttcatagatatggatacaagggagacaaacctggaagattaagttatagggagatgtttggctgttggtccaaagttggaagttaggtactatgatgcataaattaaaatctgtgcataaagagactcttagagtttgtcacaagtttcgtatcacttttatctcccaggattatgcataggtgaaacaaagaaaaattagtatatatgtccagcagagaaagaagaacaacatataggaagatgagagaaaaaagaagaagagaaaaagaaggacaaggaaaagcaaaccaagtttctcctgaaacataatgcttcaactgaccagtgttggcatgtacatgattcttggtatgggaagggtggaaggcaagaatgaaaatatgtgatttttttcatatagaactatggcggttacttatttaaatgtgctgcaacattgttgataatcacccaaaggcaattggtacttcagtatggtttacatctctctcaagctttgcactttaaaagcatcgcgcattagaatgtaccaaaaaaaacatcatactgattccaatgttaacatccaagtaccatgtaggaaacaagaaattcatgctaatgggactatagaagcatattctgccataaagaaaactatagttataaatcaacttggtttatttatcaggttctacttcactgttcattcttcctgctttgatcaaaatatccccaatctcctcttatgagttgaagcatgttgaaggaatatcaatgccactttgttgtatattccctagtcttcactacaaacagacaagtcaatgcaattgtttccacattacttcaacagcactactcctaagctctcttaatcagaaatttccacacattcacttcatcattctaatttctgaaattagtcatcctatctcatttatctattcattgcaagctgctgtatccacatttatctgtcagattaaatcaaacaacggttatcttctagcctgaccagcaggcaattgccatatgacatttcaaaaagacatctccacttctaccacctaaatccagttcaacatgaaacttcaaagatttttactcagtagcaagtaaagaaaacctcaagacctatatatccctactaaagtcatattttgcccgtgagcattaagtctcatgacctgtcatctaaagcatatgggcaccaattggaatactattgtaaattggagaatcatatcacggcagtagacgatggctaccaatctgacagtctataaagctaaagagcaagcattaacgaactgaaagactatgaaaacaaatcaaaatacgattgcaaccatatacatgtgaaaaggaagttttaaaaaaagcattaagccgtaacatcaccaacacgaagtgccagtataaaaatagggagaattttttttttttatatagaaatccagggatggatctaatcatcatacctatgatcttgaatttggatgagaagatcgaacaagaatacagggctttcagaggcagcaattatagtgtcatcttgggctccatgccagcatggaggccgaaatggggatgctgatgacctgtatcatgccgcccagtgacccaagccaaacctcagtctcaaccagacaaggaaacctgggaatctgggatattgatggaggattgtgggcatagataagagagagaggtggcccgaagcccaacaattcagaaggaaagccgaaagttggactaccaagccatcaaaaggaaggccatagcctagaaatcgagaactgcaacccataacagacgactaatgaacctattgaacgacaagccttagaaacctagattttcaattataaatggaggaggtaggaggttttgggctcagatctaggtgctattgttttgcaattcttttgatcttattaatttaatttaatgattatattattatattcatattcaaagccaaaatgtttaatggccacaccatccaaagatatctgcattccatccaaattccacattagacaaacaaggcggcaatactaaaacatttataccacaccatgctcatttgttctgtctgattgcaagaccaaccaacttgagaaacctgtcatgtatagaaatacaaagcccaacaccctcaagatgtttggcagcaccctgtttgcagtccaaactcaatgacagaccaaaaaaaaacagtccatgtaaacagcatgaagcacaaaacctagcaaaaatagcacatcaagcatttcctggttacagtcaaggatattgctgaatagaatgcccaacaatcaaaatttaacattaattctccatgttttctttgaagcagataaacggtgctattctaaaccttctaagaacactcggagggaagggaggtaacattaatctaatgcaagttagatatttaaccttataagaacaatcaaactttaacagttattcgtcatgttttccagctatttccgttaatctaatgcaaggtagatatactgcaataggattcacggcaatggaaggataaaatcaagagattacggtatgacttactcggatgaaatgaaaccctagaaacgtcaatggatgggaactctggcaaaaactcagcagaggagaagccgaggatggtcacaagctgggggaaaggaggacggcgagtggtaaccggctttgatcggaaaatcaacgagaggagcgtccgccagctttgattgtagaacggcgaccggcgacggcacgattcagggagaaggctctcgcacgtgatcgaagacaaagagtagggagaggcggcggaggcagagcagaagaagaaaccctggtccgagaaaggagcgggatctggggaggggagattgggtcgtcggtttcaccgtgtcaggctttgcgattcgagcgggatcccagcccgaaaaagcctcaacccggtccaagcttttcgggcccagcctgaagcccgaccgggcccggcatgatgggccttgagccggccacgagcccattgtcatcacttgaaaaaaaatttccgttcactttctcctctttaggaaacccaaggcatcgtggccgaggagagaaggcgaaacaatagagagatgagcgaagacgtacacggaagagcctaccgacaattcgtcctcctcgccgtgatatctcttcaattcatcttaggtttgcgtttcttctccgacccggaatcaacagttcgcaagagagttctaaaatttcaaatcttctcgatttccatcgtcctagatctcaaagacaccagcttcattttctggcgtcaaagtcccctttttttttcgattttttccgcgattcatgtatcggatattcctgttttacctgaattccggatcgctggatttgtacgcgtgtgaaaatttcagaatcctttgattgttgcattaatttcttgaagatacgtcgatttcgttgctatggtttgttgttcagaatttgtttcaaatttcttcactcgttttctgtgtatgtgatctatttgattatcaaaattcggtctgatttgccctgccctactttatataatgttaggggtaaacggaatttggtgacattgcgtcagtagaatcacttactttcatatcgtgggacgaaattcagtttgatttataactgagaaccaaatgccagtgtgtgatgtttgttctgcggtttgtagagatgtttattactggaaatattacaacttgtttcctcttttctgtttattatgagtgttttgttgttcaatcatttgtttaggctgtgtctcgtggcttggtgaatgttgttggactctcttggattccatgtatatgtggtgtatattccctgcagactccatatctgaaactccaggggatgaaaacttgagtagggtgacatatagaaattgcttcctagtgaaagtatggttatcaaaaaaaaaaagagaaagaaccaatacgagagaagaattgtttaaatggagatataggatgcaacaagaagtgtgaagggcgatttgatcaccaggattaaattttgatgatcaacaggacaaattgaagcaagctggattgaagaacccttattttgtgaaggaagttctcttaaagaaatgttgttaatatgtcaaaaagttgccctatataatgttcaaaatgatattcaaaatatgacttaataataatgaaacatgctagaattattttactgcaaacatagaaatcactggctctcgtagagcttggcataagccagctggtcataatacctagttgctgcaccctatgctacatccctcggtactatatttctcttttttttctatacagaaaatgttcttgtcagtcttggcctaaagcaatggttgttggcaattgttttaaccacagtgatagctgttgtctccttcttatgtgtcctacttggtgtaaaatcaggccttaatgcttctgttgggaaggaatcctcacgagtgtggaatacggatcccctatctaagatcgctaattcaggtgatggtgtcaataccgcaataagaagaaaaaaagataaaaataggacacaatcaaatacgtggatcagcgcaaagccaacctccatgggacatataagcttcactataaaagaaaataaatacaggaggagattacacactctcaactctcataaacctctctttcaacaagaagcacttctctttacaatgctctcacaaagaatccctaaggagatcctttgcagcttcctttgctccatgggccgttctcagccgctacatctctctctcagcccatgtacccctttttgtggggcccaaactcactccagatcgaaatcaaaattttattaggactcaaaaaacacctctgatcgttcaatcacgaccgcaagctcttctgaccttcagattgcgcaaaacaatgcatgaaccgcgcatagaccgccctttgcatgaattggttatgaaatagaccctatccatgcatgctgcatgttgcgcacttgtccacgcacgtgtgagccatgataaactcgctatagaccgcggcggtccacgcgcgatgcgtggactgcgacttcctgtggatgcgtggtggaccgtgctgtgcaccatgtgggcgcgctagtctgggctgagcatgtccacgcacgtgtgcgcacctgcacaactgggccacgtgctggacgggtcgcatgcgttgtagcgagcttgggcggcttgcgggcctacgagccacgcttgtaggcttgccgcctgtgtctacatgcctatggggctggacttctctttcttgggctgttgtgggtcaaattcgaggcatcaaaattcaacaatctccacctcgactcgacattcggccttcacctaactttaagaacttctagatcatcttgcccccatgtcttggggcaaatgtttggctgctcatggatgggcaaacatgggagtcgagccagaccgctcgataccatctttgttatatgctgtgatctgtttgacctgagatctgatcggggtagcctcctgcagtaatagaaacttcattctgcgatgtatcctgtcatcctttcgagtctttcgtctcatgcccaatccatctgtatctggagctccacctcgttctgagctcccattggctcctaaagctctacctcatgctgagctctctgtcaagaggtaatgttctccatacctcttccctttcatcacaatcctactgtcgtgcaagactttaggattttttcctcagctctccatctgtaactgttcgaatccagtctactcagtgaaagtagattatttctgaagctggatatatatcggatcttatccaactttctcactgctccatcaaatatctgtaagttgacaatctcaatgcccttgatcgcacaacttgatccatccgataaatgaacagtgctttcactactttttagagagtcaaacagctcatctctacaacaaacatgatgagaacatgcagagtctaaaattcactatggaaaaaaagtagatacctcatcaatcaccaaaagaacattatcactatcttctgtatcgctatcttggactgccatcgcagtagcactcatccgatctctgagctatgggcaatctctgactcgatgccccaactcatcatacctgtaacacctgatcttgctgtagtccctcgatttggatttggaccgcccatcttgagatcttctattgcttcgttttttgccaccacctccttcagtcactgccattgccgagtcatcatctgaactcgaagctcagttcttccatctgagaacctcattctggagaagtgtagaagtgacttctttcatcttgatggtgctcttccccattagaagagtagtcaccaaaaactcaaaaggaaaaaaaagtaatgaaggcaagaccaatgccttggtcttctcctcaaccttcttgccaatgctgagaagatcagtgaggattttttgaaagttgctgagatgctcctgcatgctttgtccctcactcatctgcagctgatagaactgctttcaaagaaagagagcgttggtgagtgacttcaccatgtacatctcgagcttcatccacatcgctatcgaagaagtgtcgctaagcatatggatcaccacatcatccgtcaagtacaagtggatcgtactcactgcttacatctggagccatctccaatgcttcttctccatggtagtcggcttctcttcgcacaagagagtatcaatcaacctttgttggatgagcacatccttcaccctcgcttaccatagggagaaattgcttttcccatcatactgattgatctccatcttgattgagcctgtcttctctatcttcttcaacatcgatcaataccactacaacttaggcaaccacgtatgctctgataccacttgttggaaaagatcccttacgagtgtagaatacatatcccccgtccaagatcgttaattcaggtgatgatgtcgataccgcaacaggaagaaaaaaaggatgaaaataggatacaatcaaataaatagatcagcctaaggcctacctccatggggcatgcaagcttcaatatgaaaaaaaataaatacaagaggagatcacacactttcaactctcataaacttttttccttcaacaaaaagcactcccctttataatgctctcacaaagaacccctaagtagaccctctacagctccctctgcttcacgggttgctctcagccgctacacctctttctcagcccatgtatccctttttataaggcccaaactcactccagatcgaaatcaaaattttatcaggactcaaaaaaatgtctgaccatccgatcatgaccgcaagctctcctgacccttagatcgtgcaaaacaatgcatgaactacgcatagaccgccctatgtgtgaatcagctgcgaaatggaccatatccatgtgcaccgcatgtcgtgcactcgtccgtgcgcacgtgagccgcaataaaccctctgtagaccgccgcagtccatgcgcggcacatcttgggctgtgcgcgtccgtgcgcctatgcgcgtgggccgcacgctggataggtcgcccacgctgtgcaagcctgggtgcctgcaagccgggcctacgggctgcacctgtaggcctacttcctgcatttgcctgtggggttgcgcttctccttcttgggctactttgggtcgaattcgaggtgccaaaactcaacagcttcatcattacaacccttactacatgaaagaaaatacctaccattaatctaaaaccatcagtctggaaagaagaatttggaggtcaccttgaagaaaggacaatcagaggaattgtttgttgatgtagtctgttaatggtagctcaatcattagggaggtcgacacatagaaacaaagaattatcttacttaaataaaatgggagtaggcatgagagcagatttatgtatatgtgtgggtaggaagtttttaatatcatacaatgaaagtttttttaccttttagcaagtttaattgaaatctcccactttgtttcatttcacctactttgttagaattggaattttgggagtgtgactccaccttaaagttttttgtttagtggcattccaatggtttagcttggttagaaaatttttgaggatgggcctcttgctagctaatttataaagtgattgagggtgacctctactcaactcttaccagtcgggggtgttaccaaaagatagattgaaacaaaggatataagggctcttttcgtcaaatcttgactcatcaaataccatgttcatcagtggtgatattctgataattgcttgccttgcctggcttttttaccccattagttcaaagtgtgactttagtgtgaacagaattcaagagcatgtagaaataaggaagagccactggggcagcgaggaagcatgccaacatggaattctttctattttctttctctctcttgggtcccaatgaatcttcctttaatacctagataatgatgctttgttagagggtggtttacttgattcccgctactgcttgctttccccttgtctgctaacttagccattaaagaaaaaggaaaaaagctactagggcgggccatggtagagtttgaagttagaagttgctattgttaaatccgctcctcaatcttgatcttatggatgatttgatttgtgagtggagtggagattcccgaaaaagcctttgcaactttgctataaaacaatattgtcaaaatagcatctctgctattcccttcttcccctccttcccaccactctccccttaatggattgtctcgttctatgtcctactaaataggttggatggacttaaattccactttctgtttttctagaaaaatgcttttcctttccatggtgactttgcttggtgtcattttctgctctttatcatgctaattccttcaacagaaccaactcggggtgtttgagacctttgtgagtcgcatgcattgcatgtccctgtctaataatttgtgaaataaatggacatagacttactcaagagtaaagctcaaaaatcactagtcagtccaaatcacaccaaggtatccaacagagagtaaaataattaacatcattttatgcaacctccaaagtcacaacccaaaaggcatataaaaaatagtaagcaatttcatttttcctatactttagcaggggtattgttctgcagttgcaaagggttgtctactaattatctgttgaagatggaaaggccttcctggttgtcgattgcatatcatagatgcttggtataggatgtccaggatgatagaacactgaatgatggatttctaatgaactataattatacttgaaaaatgagtaataaaatatacttgtttgaaaatgggtttaagaattaggaagcaggtgaccaagcaggtacacaaccataggagaaaatttttggctaccaggcacaaatgcacatcacaaaatcttgattcattgtttttgatttctatagatttctccctttttctttcctcttcttgatctgagaattgcagcgatatcttatgcataaacaaagctcaattaggtgctggtcactgaattcatggctactaaagctttttccaattttctaaagattcaagagtcggagaatccggttaataatgagcttaacttttgttctttgaggcttgaatgcatcattattgattatgaaaagttgtctttgataaactgctacttgtagaaggaagccaagtggtttctgtacatcagaacatatgaagagatggtcttttgcatgctattctttcctaattctttggtcgttactttattttttggttatatagattaacagttttgaaagtttagtgaccatactatcactttagattctttagacttgttttgagttaaactcaattatgttgatggcataggatagttcctaccagaataaataaacaaataagtaaataaataaataaatcaataaaaaacacataggctagcttattcaaaaagatccaattgagttcatggaggtttaaagtgcacaaggcttaacaaaggccctactttcttgaggttcatatcctagatttcattagcagtaaatagctaggttgaacttttacagaatggctcgtggttggttgaatctctactagggcttcggaatgcaaggttaaaaaaattggccttaaagcagtttagatgaaaggacaacttagttctagtgtttgctgcaagtttctggaaaattatgggattttgttttgaaaaatgaagattgattaggcgaagtaaaatatgtaaatcataagaaagatgcaaaggattgaagttttaggtctgatcaaagggaaaggccttcatttcagatcaaaacaatgacatctcagagaataaaaaagggggtaaaggaaagataagaattataaaatattttgtgggtgcactccatacctaaaaattgctcttggacattcaagttgcatagtttgatcagtggctccacacacgaacataggtgggttttttttctccttcaaagagatagaacgcctgaagtttcactaaacttcttcataaaatctttctagaatgcccctctttttcctaaaggccaggacttcaaagaaatttgttgagcttttacgtgtaactattagctgtaaaggttgctaagaaatctgtcgagacatttgcttgccatccatgatcatcgagcaagattttacatctcaaatgaaatataagtagtatctgcaacttgtattccacagagaaccagatcaatattgaatggtacaaactgatatagggaaaaggtcttaacaaaattaaaattgttctggcttcccatgtttgttcagcaggccagaattggaacagcattggagattgtgttcaatattgactggttttggacttaggtatgtttgggcttctttctggaaaaacctgcctttgcttaggtttatttatcttattatgtatgtactgaaaatggatatgtgctgcaagtaaacctctatgagtaagttattggagactagagagtctgttgtaagccaaggtttaggctgcagatctaattttatttatttatgcttttggattggtggtttgttgacaattattaaactagtctagttgtaattttcctggctctgttaaattgttcttgattttaattcattctatgcaatgccttctgatagctttcatttcgttgcaggcctaggcgacggtccatcaacttccaacaatgcaacaacggctgatgcccgttccagctctagtagcaaagcaggaattgagatactttatatatgtcttggagttgccggttttgggatattgtctattttccttttcaagcattggcagaaaaagaagagggaagagcaacatgcacgcctcttaaggctgtttgaagaggacgatgagcttgagcttgaacttggtcttcaggattgagaacttgatcgtcaattgatggtaatgttatgggtgagaatgcacctctgaaatctagattcaattgcgagaatggttactagcattatcacaaggattataattgggcatgagtgtatattatgaattgcagttcttttgttcttcccaaagatgcaagttaaatttttttcttgcatatggcaaaaaaaaaaaaatttttccttgtggttgttttagaaaataaccccattatcagccatgatatgtactcactcatgaaaatgacttctccatgctaggcattagcagcatttttttaattttattttaaggttgatatcatacagtcaggatacatttttagcagtttaacacaattcagtttgaagtggaaggaagtgaacctgacagctaaatgagatacataattgatcttaaattgttgatttgggcctgctatgtagctgactgccgactcagttttggttagatgatataacaaagaagctggagcaataagaaagcaactcattgtaacacatttcaatttcttctaaaattctacctttatcaatcatctattctaactaaagcaactcactgtaacacatttcaatttcttccagaattctactttaattaatcatctattccaaatcgatgaagtccatttggtattatcccttcaaattgctgaatgattaggtgttatttctgcatctcattcatttctccctatctgaacatatctttcttccgaaagacctatgtggacatttccttcaccaatccattcattcaatgtcctttgtgcttcccgatacccaaggtcatcctcgttgtgaagttttattaggatagtacctggccttccactaactaggactcctttagagacaaattctcatgtggtggacaaggttaattgcaccttttgctgatcttttttccaatataaacaatcactactttctgtacctggttattttgctgacactgactcatgcacctttgttgcaaaagtccgtacacatgaaatttatcatgataatgtgcacattaatcttttggtctcacttggctctgtagatgtatattatttaggaaattgagcagatatcatggattctttttcccatgattcatatgaagaggggaacttccgtcttcaagaagttgcttgtataatctttctacaggacatattgcaattacttctgtgtttatcctttattttgacccttcatggcgatttctaataaaatttttgtttaaattacttgcaggtcttggtctccattcattaaaatgttctccattgctagtgattgttagaattttgttgtatccgaaagttttaagccacatgcagatgagatcagatgtatttcatttttctgtatttaatataatgatgttattgatcaggaattcttccagtaaatggggattccccttctattttcattcagtaaattgatctgaatttgtacaaatgcattagtaattctcacactgcaggttccaggtactacatgtttgatgtatatgaatattttgtatggacaactttgtttccatttattcatgatgtgaggacaagcttgcaagattaagccagttctgtttctccaagtttattttgtcatattgcactgtcaaactttaatatgaaaaatcccacagaatgaatgttagatgattaataactttgattatctctgaaagttctgtattctaatatttttgtttttactttttctataatgataccttcatggcgcagatcatttgaatagattgctcttctctaaagaggaaactgtgatgcggaactaagcatgatatatatggccctttctggcttaagccatctatgcttctgatggtggataaatgtttgggtaatgatgttttacatgctttttgacgcccatgcatccattatgattatctaagcatgttctatatggccttttctggcttaaccatctaggcttctgatggtgtttaaatgattgggtaatgatgttttacttgctttttgacgcccatgcatctgttatgattatctaagacataggatacaatagtatcatttttggtgagagggatagagtatattcttatttaaggttgttctcctgtatgaaaccaatgtttgaagccttcattttgatctgtggattcctattatttttcctaaaaaatgatgctgatagatggtttgattatcatgtagcttattttttaagtattatacttactgcagacactgtaaccttgggacctatcagaaatttgctcagatgaatgcttgcatatttttttgtagaatgccagtcaagttattcagaaacattgatagttcatttcctcatcattcattactctgaaggtaatcttgaggggctatcatggtgaagtggctttattgttgaaagtgcttatattcaatgtgtttcataattctgaagtaacttttacgtaaacaatatcagacaccagcattggcttactgttttcaggcagtgcgatcgttttccaaagagaaatgctgtcatcagaagaggatatttgttttactctgcttaattgtgtcctcataattctacttgatttctgggcctcctattattttctatcatatatcatcagcttcaaatggatattttgttttgctggaaagaacattggtgtatcgcaactattgaagttttgtggttctgtagttaaaggtaggagaccagatgtcgaggcttatggttcttttgcagtgctgtcaaggcttatgttcttttgcaatgctagtggggtctgctgtttggcgcttaaacatcagaagatagaccaaacctctggaatgaacatgtttgacataactgatgaagctagaggaagtgggattaaatagatgtacaggttgtaggttttaagttaaaagaacagatctgtgtgtgcatatctttgaagtaaatgaggccagttttggagttcaaaataggtccagaacgtgggccacattcaatggcatatatgagtaaacaccattgagtgcatgacacagcaatgtcatgcacacatggaaaatgatgagatgaagatgttttatcagggaccagagtaaataacataggtactagtagtgacagaatatgatagttttttctgtcctattccagtttagttttgaaccttggtacagaagtttgtcctaagttggcctttgaatagattttttcccctgaacttcccactcaaacaggttaagctggtggagtgggctgtatttcctattaccatgaggtgaatgtttcataggttctctgatcaagtggtagccatgtaatcaagtgagtcatggttcattagtgttagtcttaatacagcaggatagtatcttctgtttattctttttccctgcttctattatttccttacatagggatcaatcatcgatgttttagctgatatcagccattttatttgttgtcgaggatcccaacacagcaaatgttttatgttgattcacttggtttcagatctggtttatggagcagtatgctgagaatcatatcatgagtgttcttcatatgcaccacccttgcagcactgatttgggtaaagttgttgcagtattgattcagtaagaaaagctatcataatgttctcacaaccatacggaactgtaaagcaaaggatatgagttgcatgtgattctcttggacctacaccatgatttaccttaactaggattcttatttggaaacaacaacatgatgtagtgcactaccttcatgtctaagctgtactgttcattgtcacactacctaagtttgctgtgaattcttaccaaaagaactgttgaagacactacatgggctcctgccttgtacactttggctttctgaaagttccttctgtacagcctttcaccaatgaaatctgtttatttttggttccatccaccaattattgttagagatttgaaaattgaagatgcaaatcatactctttcatggtggtttctcaatgtcctgtggtcatgaaaagtttggttcatattctgacctttatattgccaatcttttagttattagacatactttaggcccttaactaatgctttaatatcatgaatacagaacatacatttgatgagttactttaaatgtagcatgagttatagatgtgtagtctatagttgatggtccagattgatgttcacagttcagtcatcagttggagactggagggtctgggattttagattgcaagtcttacgcaagctagttttaaacaaacatcttccccattggtcagctttactgggcaatgtttttcccagggtatctttcatgtttttattggtaatgagagccaggctagatgttaatttcagttcagctaccaagttgaatgtcaaggtcttgatatgataaggtacatttctgtagctgaaggactgtcatgccatactagttaccatttttcactatgtgaaattgtctctcactctgccagcctttctatgattgctcagttttggatggagaagattgtatggaactaaaaacattatatgccaagttctacaatattactcatggggtcagcctgagtcactgatggtcctggtcaatcgtgtcattttcagtatggctgtaatcaggttccatgaactaattctctctcaatgcctttgccttttccttttgtttgtgctcaacttgctgattctcgtcgtgctttcagtcagagtatctaatgacatctagcgtggtacttcctgagttttgagctggtgatcgccatcatatgtattattcttccgaacaggtgggccaggaattatcacggatagggaaagaagggaactctgttaaaattttgatagtgaaaaggatttggtaggatttactctggcttcctatagttaatcttttgtaaactatattgcttgaatttttgatgtctcgcttgttataaatcatctaacatactttggatttcttctaccttccatcttggttggcataaaacaatctcaattcatctttatattattcattaaatcacaagcatacacaggtatggcctttaaaatcctagttgctatcaatatttgcttcaaacgaacttggttgctgcagcagaagagatctcttgcccctttttatatatagaatatcaatgaaaagtggaagtatatatatttcttaagtatgttaagaaaaaacttctagttgctaagcagaattggtttcattactgagacaagtctgtactcacgaaaaaatgatgtgatttaataaggtggttgatcgattttgtgaattgcactgtacaacacaaactttatggatcaacaccaccatcaacctctcaaaattatgctcatttgtagggccacatcctttgtctattcctttatttttggcttccttggtcccctgagagctggagatgctgcttacctcaacctggcaatgaaaacgaccctctcgctcacacgcacagatagctatcatgttggtaggtgggatgggtgtggggcagcttcaacttgcctgcaggcaacaaatgtcattgcttgccaacagccattgggagtatggtgatccacatcatgaactctgtatgaagggaagtgggttatggaaattgatttgtttttgttaatgtttttgccatggagattatggaaatgggttagggaagttatggtttttgatttgcttttgttaatgttaaaagtgaacaacaataactttactaaaaacttcccctttagactaaaatattatgtttgaactttaaataaatagtatattagtaccagtagttgcttttaacagaaatgttttagagatgataaatacttaggtgtatgagagacaaagaggccagaaccttttcactgcttgtctcttaaatttttgcatgtacctggcgtttcttcatcttgttgcctctagtatatgcctttttaatatcatttaatcactcggccatatacatatacctacatgtatgtatgtacgtatctatctatctatatatatgtatgtatgtatatatgtatatatgcatgcatgcgtgcatgtgtgtacatatataataggattggacgggaagaggaggggaaatcagaaaaaaatcacagaaaagccctcaatggaaaaacactctctttccattacaggcccaactcaagtatggcctaacaaaaactcttttttccagggattagttatgatttcctcatccctagtgtagcaaaacaaactagtagaaaccttgggcaacgcatgaaatagagccaagaaatataagaacgtgtttgctttattatcttctctagacaagcgcaagtcatgtcctatgcacatttcgacgcaaaaatatgagattttatcaacaatttgaattattttggtggacaaaaattagagaagagatgagactactcagagacagatatcacacatgttgtaaagcaactaaacataacttttccaatatttacaaaagcaggaagcagtaactagaacactgatatcatttttctagaaaaatgaagcgaatgatggtcttaatttttttctttttgatgcagtttatagatatgtatgtttccatgctttcaggatttattgatgagtgaagtttagatactacctgggtagcactatcatcaagctgccatgcattgcactcattttaaattgagatgactcaaatgagtgctatgtgtctccaaaattatagatttacaactattaattaatgtttttaaattttaacaaatacgtgccaacaatcaaagtaacacatgtccaatgggagtatttggacaggggttagcatcatctggctgcctgcatgtaagtcaatatgtatttaatttctaactatgaacaacttaatagactcaattgttatggttttcgtggcaaagctgcagacgacatgggcagacattatttttgctagactaaagagcagagagacgattgacggggattccatcatggtggtagcctgattacataaacaattatcatcagcagcagcgcatcttctcattcatgatagtcagtgtcagggagctgcttttctattgagattcgttatatttatcgagaggtcaatagctctactgactggatgatcttttatgtgactgagcatatcggagagacggtgtggactaagatcaaagatcttccttcgaccttcaagaatatttattttttaatttttttggatgtattcgtatgaataatctagcctatcaaaaaaaaataaagtgacatgtggcctggcacaaagtcacgtgaccttgaattccaacaagcattttagattataagcttacaccatgggcgagggaagttttccacattttcttgctacttctagacgcttggcatacacttacatgtctaaccaaatctcatagtaacagcaaattgcttgaaatacagattgctctatgtcaaattctttaggctgcagtgagaaaggagataggcgaaactgaagaaggggtggaaaatctaaagttccataccaccagttcatgcaaacatcactggttggtcagctgacctctaacaagaaagactattcacatggagggatgacccactgatgccccaaaacaataatgcaaacaaagagagggtcgctctctcacttgagcagcgtagggatgccagtgagtgcaataaagaagtggggacgaggtattagaatttcgatacatgtgtgcgtgtgtgagtatcacagagagagagagagagagagagagagagagagattgcatgaaagtcctcagagtatgggacatctccaaaaccaagtccaatatctagtgatgggctcttttatacaaagagtgatgcgcaagaaatagaagacatggaggtgagaagcttgatccatgcatgcatgaacatgatgtgagagagaccatgaagctgaagaaaggtccatagccacagaggcaataaaagaacatggttgggatgttaaatcacagtaaatggtgaaaagaacatggtgcaactataaggggaactagttttagtagttcatctttttaggaccacaccgcaaggtggacagttggtgttacatttagtctctcttcattctcttttaagggaaaatgtcatctagagtttgcagaagttttgaagttttacaatatcgcttaatttaattcaattgatgaacaataatatttagtgattgaaggtgtgaactgtaaggtcacttgaaatttagagtctatacacattgggagttcaaaatatctggtcaattttattaaaatgtattgttccaatattaaaattttctcgagttttctttaaaggactctagtgttcctttgatctaaaaacagtctaattttttgctaccacaaatatactacagtagaggcaaaaaaatctagataacacaaaggaacaaacaactttatgtttttaagcaagcaaataagtacatattcttccaacgttttctccaagaacatgatcaatagttcaaaatgtttgtcccttgatattctttacagaaaaaactcacggacaataagcttaaatcttcatggccagtatattttgtaatatatggtgaaactggagttcagttgttctacaatcctaataagatcataggggtgcaattcttgtgtccttacacttagggaaaaagctttatgccccagctagaaagattatatcgatggtcccggaggagtcttgatttagtacataacttctaaatgtggagcatcgcccaggaaggaaatatatccatattaacaaagtttgcaacatttggattggatgatagtccaatgaagaaaaattgacctactcaaccatgacaatggagctgtcctcctaacatgataaggacatagcaaccatactttggtgacattttaaaatcatgcaattacttcatcatgtttaccatggaaaattacacaagaagatggaaaacatagcatagcatttaccataaagaaccatgcatcgttacgtcatccaagcgattcaggtgcatgcatgtagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatctaacttaataacgaagtcttatgtatgctaagttttccctttagaatacttggaaggcttgacagcatgcaatcattcaatcaaaacaagagagataatagattgtttcagagctaggcttttggaacaagtaaatatagtaatacaaatagacaatacaaaagacaacatttttgtttccagaaaaccattatagaattttctaagcctttcccttctaatgaggaacatgttcattgcaatgttagagctatatgactaacttgtataacggacatgccacgttagccttgagtgatcttgaaattgttgaattagtccaacaaatacgactatttgctgacgcctagcccaaataaaacagaattaacatgcagtctagtctgaattagtggcttccactaaggattagaatgtttctcctaactatagagcaagaagacctcttgtatttagcaatgttatccaagctggtcgttattattcctctagaattggctcccactgatcagctaccaaagttagtccacagcacatagtcccaaacatgtcattaggtttaccataaatttagtatttcttggtaaatagaggcaaacttgctgactgttcatgcaattaagttaccttgacatatgtgatgcattaattacatgcaaagaaaccatctatcatttggagcttatactggaaattgaatttcccgagagaatctatatattcatattcgttcatccctcgattgtattttcaagaaaagatttgaattttaggcaacatacctttttctctattggtcttaattttttacatttccaactacttaatgatatgattcagatacatagggtttctacccatttttcttgaaaagaaaagaaggaaaggaaaatccaatagaatttacagtgcattgttgaatctgcctaatctgaaccatgactttaaaaaaaaaaaaaagaagaagaagaagtttctggctacatttttatatcagcttataattagtttttattaatagtactcaccaggaaaagtgtaaatattaattgttcttatgtattattgcttttcttagtgtttttctgttaggaaaacaaaagaaacttgaaattgcactaactacaagtataaaaatgaaaaaaggtaaggccaatgttagagagcactaaggcttcatggtataaccttcaaaagttgtgatggatacaataccataggtatttgttcttgctagccataaaaatatacaagcatatgagggtagcacatggtaagtagacacaaggtatatttatcttcatgatatcactacaataacctgatgatatggtgatgatgttatccataaccttatcaataatttggttttgattttctacaaacagggatgtgtttttattctttttgaatatatatatatatatatatatatatatataagaaaaaaaaccttggcaccggtagggcatcatgttaattaacagacatgataatgtagtactaaaagctacatctaatataattgtacttttactaacttgatgtgaaacttaaaattgtattgcttgggatcaccactttatgttgcaccacttttgtgtgttcttgagcatatctgcgcatatcctctttcactcgcattatttagatattaagtgcaaacatttaagaaccagttatccttgaaagacatttgagactgcatgaatgccatcagatttcttggccaatggaatgaagcaggaatggatgtaatgtgatgtacgtgggtagaagggacagcgttaacatgaaacatgtggaagttttaatattttgagaagagatacatgcaagttacaaaaaaattaaaaaagaacatacaaaaaaaaactatttatagatgaaagaaatgaaaagaaagaaaaactttaaaagaaagaaaaaaactttaaaatacaccgcaacgattaatttcttattcaccatgtcacctcttctatgaataacgaatcaagaaaagatctgtggcaggtattgccaagccaagcttcaataaggttttgttacttctagaatccaaactcccttgacctcatagttatgcgagagtctagtctattcattacttaattcccccacctaaccctaatctgagaaggaattattatggcttggggagatcacgtgcggaggaggcgccaccgatcgttttcactttaccgcgcgcttttcagtcctagcagtgcccccccagtccccaccacttccctgtcaactgctccaccgcaacctctcaatctcctaacaatcactccaataacgacaaaatgatggagctaacccatgacattttatatcgaagatatagtagcacaaactccatccggcggtacagcttacccagccaacccaccctccactctttaagaggaaacccacatatccgatgccaattgcatgcagtggaaagagagagagagagagagcgctgagctcccttcttttccctcggaatttgcggtgttggacttcaccttctcttccggcgtggaagctgagttcccggagtggtagttttttcctttttttttttttttttttgagaacaatttctgtctttctttctttctttgttgtttcggctttttgatatttgtttcctttcttgaggaatagtttttatgataataccggaattgggggttgctagaaatcgtgaggtgtcattgttataggttttttttttttgctggatcttcggcgatctttttgctgatattatccgtttttaacgatcggaacgttggttgcgtcaccaacaaaatgcgactttgttctcgcttctcgctagatttgctccacgaaaacagtagctttgtcggatcggatcgtttgctccatgtctagtttttagggttatcttttcacatgttcttgaatatatctttgtcaagaaaaaaaaactttccttttgttctataacaaaaatcttttcttccacgtattttggttgccctagttttttcttttttttgtttgtttgtatttgttagagaatcgagatttgagccgtacatctcgttcataaactgtttcatttgtcagaatttaaagaaactaaacttcacgtatgcatcgttatccatttgtcatgatcttgtctcatgaatatatgtattctgttcttgtcttcgccttaatttttttctcactttcttttccgaaccctaacccattcaaagttcccaccttttctctcttacttgctttcattgttttttttccttttttttttttgttgcttttaattttgcttgaataccttttgatctatggaaattaataagtcaatatgtcagtatgtgaaggtctaggccatgttagtcccatcatttcatttatagtttagatgatgattttttctttgttcttggcaatattctagaccaacttcagcagacagaggtgaaagagagatcatgggtagaggaaagattgagatcaagaggatcgagaacaccacaagccggcaggtcactttctgcaaacgccgaaatggactgctgaagaatgcttatgagttgtctgtcctttgtgatgctgaggttgcccttattgtcttctccagccggggccgcctctatgagtacgccaataacaggtatgctttgatgacgccttctcttccttcgctcatatcaagttaattttatggcttcatttgttctatggccaagccaaattctttttaaagttctagaatgttaatgatggtagttttgctcctcttcaatttatttgcttcccttttatccctgatccaaatggtttttttcttatttaaaattaccctttcaaattatcacatttaattcagcttttattattattattattgctatgagattagtttgttgttaagattctatataggaaggaatgatcaagtgatcattactttatgtagtaagaaattaacaagcaaaagcagcgtgcttggtcttaccatgaggatagaggaagagttttaccttgactagggcaactaaaaagggtttgagttttgcctaacattcttgttatatgaattcgatctgtacacgacttactactctggtattagaacgtatgtactaagaagttttcttgggatggaaagaaagaaatagtgaagtaaatcttattaatttgtctttacatgttcttctcatattttctcatactcttttcttatgttcagacttacaccgaaaaattaagatggatgatattatgttcttggtataggatttcttttccgacgtaccaatgttttgttaaggaaactttgtagttgacttttcgattataatattttccaaaggactccacgaaatggtaacatctccagtcgtttcaataaacttccgatcatattatgggtttgcatttaaggttttcttcttcccttcgcttcctctttgcctttgcctttctcgtgttacacttctggctcgtcaatctgcagtactctctagccatctctctctctctccatccacacccccccccccccccaaacaacacacacaccctcccaccctgtgcaactaattccgacaaaataagggtctcccattgttagagcacctcctgtatggactgcattctaaagatacgggaaaatgagccagatatctattcatcaatcatttagtagagtctctaaggttcctttttaaaactgtcttgaaccggcttttgcacaaagagcaccactccctttatttataagttgaaccttcctgaaagctaacttgggtttcagctttcactgttcaagtaagtcataaagtttttctggtcattaaaccttgtgatatggagatggaaactgcttttctccctgccggatttctcttctggtgctaagcggctaaaacccatcatccatgtctgccttcctcttttatgggtagttgctggacttcggacaccggtgaaggatgaaggctctttgtgattggttatgagatatttcttgggccccgtgcctttgctgtcattccccacaactcggtggccatcatagcttttttgttagctttcgtccttacaaattcctctctggttctttctttcaccttttcatgcatttagcttcattgtcaacatcaagggaacacagaccggaagaagagcaagaagaacccaatcaagactggattttacaaatcaccaaaaaaaaaaaaaagactggattttactcgacgacgctgcagtcttctctgctctcactcaattaaaataggaacaaggaaaatgtagatattttttcccttttcgttatgataattataatctaagaaagattttaaaagcttactgtaatcatctcatgttcaactattgtgttgcacccaacgaaatttctgtgtgcctcatgacgagcattacctttccatggttctgacacgacattgcatactagattttactgtgtacgtaaaaaagcactgcatgacatcatctctattcttcttcttcatccctttttttttttttggtaatatctattcttctttaatgtcctctctgataactggtcttatgtacaggtacatctttacaagccttccgagagaatatgaatgcgtattttctgcaaccgagtatattctacaaataaaatgttagagattgtctcgaactggtatacaagcacattcctgtacgtgttgacatgaaagaagcatagatcagacaaaaataatagtacgtgacaaagatcataaagggactacaacattaggagggctacaattaataataacaacgggagcaactagcagtgtatacggttcagaccagatcagtttagagttatttttggaaccgagctgacttagttgtttttctaaagcctaaattgaaagagaaaccgattcaacctgatccgaaatactcgatttggtttcattcagtttatttgggttgatgttccatagtttgggctacattgattgcactaagtctaaatataaaaatttcattttatatagaattgatgttcaatggaccggactaagtttaaacatataaaaatatttaaattttgaaatatatatgtacatatacacatgtaggtcgggtaggtttaaatatagatacttacatataaatggattgggtctggttgggtcaatgcgagtctgcttaaatatatatatacatatgggctaggtcaaatcaggttagtttatatatatatatatatatgtgtatgtgtgtgtatcggatttgttggtttgcactgattttctaaaaaataaaatcgaaatcgaatcaaattttttctgttcaagagtatctcaaactaatttttaaaaaaaaaatagatataactagatcaaaaaagaccgatttgaataggcactttatgattttgtcacttttttgtatacctctacgagcaacaataatagaaacaataataacaattgtaataatcaatataaaaattattaatagtaattaaaaaatatatacaaaatttttgcaagcattcaagtggacacaaatcaaagggcactaatgcattcataaaaggttgctagctttgatccatggtagcatcgtgtatcctgaatcatttgtaggttaattgaaacctcctaaattgcattttaaataaaaatagcatgcattttatgaagataaccttactattattaggtaataaggttgttaaattctaacctaattaatatctcctaattaagagataatagttgtggtggaaacgagatggagagaaagcacttcatctctcatctttcctctctaaataacatttcactaagagatttaattattggatcaaggctagccagtttgttatctttttttgttctagaagtgttgaccttttaccatttctcatatgaaaaaaaacattatctaagaagaataaattattatgatcatgaggagagagaaggggtgttaaggttattggattaaaatcaaactgattagaggaccttgtttgctattataaacccatgacaacaatcaatatgcactaaagttttggtataataagttatcatcaagggccaaaaaggattaactcgagaacacaagcatacaatttaacatcgtacatagataaattcaatttaggaggtaattattgatgtatatgcttagacaagaagaaagtatagaaagtaaggaaaattgcttgaatgatttagaagtgcataaatataatctaaatttgaggagtcttatttatattttgagaattagaaagggggagaaaattgaacaaaactttgataaattgattgtaagaattttcaaaccttaaagcgaaagtgatagtgaagtggaaccattaaccataatttgatattaaaaggttatctatattcattaatatcatttttttaaattattgtatatattttttgggaggaaaattatgttctttaaaagttagattggtttcgtacttatcataaatgataaatgatctgaatttagtttgaaaattatttgacatataacctttgataagaaattacatattaggattttatggtttactgtcatatagttctttgttttgtatttatttaactttgaccataaatgatttgaagtcaagatactttaattctagcctccccatcaacatgttgatggcttatgatttttattttttataacatttatttttatctataatatttttcattattaatttaatgaaagtggattacacgacatctaacttatatttttgaaaatagagaatgatatggtatactattttgaacatgttcagaaattagaatcttattattgttttcataaatttaaaatattatacttgtcaatatgaaacatattaaaaatgatctaaaatattttttaaaatttaaatgtcataggtttgaaaaattcttacttgtaaatatatgatttgtaactaaatatttttaatggcatgatattattttctaattccatcaaagatctagaacctttcaaattagttgaacttagatacgtgttttaatatgtcttaatcaagatcaacaatttgacttcttattttatatgatatatggtatattctcacttgatgcatctgtaagaaaatttaaaattcttttattttattttatatatgtgtcaatactataattcttgattatatggatttctagtacacttagattgtgattgttgtttggcattggaagatcgagacaattaataccataagtgggatatatacttgcttaacccaacattaaaccaaaatcacctctcgacaatcacacaaggacaagtgtactcaagataaacatggattgtcaagatatatataagaataataaatcatgtatataattttttttcatctacaaacttctcttctttctcttaatttagtatataacttccataccaatagattactttttatttgacccaaaaatcaatttaaccttttgtttttaatttaatcctttgtcttcttaaatgactcagcttgtaatttaaatatatcattacttatgcagtaatgtccatttgttgtaaataaatatttggcaatagaagaaatactataaggtcaaaaaatataaacaggacaatgaagcatttcgtatagtctattataaatgtagaatgaaacataataggcttttcatttgatctataattaaatataattatcaaatatcaaaattaatgtaccaatttatgagacatcaatattataaagggatactaagaaactaacgagagtacactgatcaagaaatgtgatcgaccagtgaggcatgttgtttataaattaattagacacgttttcaatttatgagaatttgtattcaaatatttataattgataaatggatcactttttatttgctctttatatttagactccaaatagtgctgtaagagaaaaaaatttgaaaaaataatttatattttcaaaaaaaatatttttatcaattttcattaccataaaaaaagatcgaaaataaaattaagaaagaatgagataagtttgataattttagacatccgcttgcataatagttcatgtttaatattaatttatcactgagaatgcaaaaatatataaaatttttaattaagctttgctacatataattattatatatcacttacataaatgatttgattaaatatttttaaaattttaatctaatttttaattgcatagatatctattgcagtaattttcctctaaataataaattaaactaagaaaataaaaaatatttaataacaattggaatatacttatcaatcctataagaataattcctgtaaaactccatccatttaacttgcatcatgcatcatttatttttttatttttaatcatttagaaatttaaaatcaaaattcaacttttatagatttattagaatgcatggaatgatttcataaatgttgcattgtactaaaagaatttatgataatctatacaagtcaagcatttaaattacttattatactttacaatagtaaactaccttttgagcaaaatggtggtaacccatcataatatgtcatatgataaataaaatgaagtacaaggctagataaagaagggggacagaaagagagatatagggctcccgagcttaagcaaccaagcaattcaatatagttgcaaccaataaaatccgatatgagcaaatataaatataactcactaaaagcccaaaatacacccaataagcccaggtaaccactagcccaaacataatggcctactaagtttgaattttaaagtttaagtctttgcccattcaccacctctaccttccaagctctaattattttaatgccattgcaaatcatcatgtcttctcttcttctaatttggtgtactatcattttcaatgtattgcaactctattgccaatcgatgctcctccaaggcatctctcaagatctcatttggctctattgcgctaccactaccatccatcctattactctctagatcaatatcaaaattaatgcagctcttttctcgatactttttgcatcatcatctcactccatcatcacagtctatacttgttatttggagcctatgcttgctactatattgtgacctcaatattacaatctctacttgttaccactcaatgtccatgcccatcttccatgaaagctacttggcaaacaatcctaataggttccaaaaaaccccacagctaaggactaaacacacaaccacacaggttctcttatactctctttatttagattcaaatctacatactaggctaagagtccaattctagtcaaactgaatcataaacatcataatcaatccatggtcaactccaaccatttatgaagcataagatcttatctaaaaaaaatcaaccaaaagttattatttggcttccttatccctatataagtatctaaatatcctttgtgtacaaccaatatcaaataaaatacatgcttgtgcggagatcctcacaaaaatatttagcaaaataatcctatcaatgttgttaggattgatgttgagtcataaatcatatatatagtggattggattagattcatcatcgatcgaattatagatcattagatctttttgaattatttaagatttttaaaatatacaagaaatgcaaaaattaaaagtataagatgaatatagaattgatgaataaagaaccaaaaaatatactgaactaaaagagagagtatgttggcttaaccaattgtagcaaggtagaaaccccactatggtatgtataacataagaaagaccgttattaaaagagaaacagatgcaaatcactttattctaagattaaaaatactatcttagctagctactttaaggatacaacttttacacattcactcacaaatcctagagatttagcaaaagagaaaagagagaaaaaagaggaaaggcaagggaagaatagttcctataatagaattttcactagttaataactcaagtatctctaggatgactacaagagtagctccaataggatatttgtaggtaatatataggaactcaattcttaaacttttcaatgtgggattccaaatttcattctaactccaataattgtaatgcaaatttttctaacaacatcaaaagttattaacaataaactcataacaattaaaacttttcaaaatttattaatatcaaactctcctaacttagacaaaaaatggatagaaaaataagtaatcataaaaaaactagttgacccaagtttataggatttgagacctatgtagcctaaacctataacccatgtggttagaacccacgatctatgttgttaggacttgcaacccgctctagcatcacatacatttaagaaatctaatttgcttccttataagttcatatatatggaatgtctaataaacaaatattgtgcctgattattcaagatctatatttgtaccatctgccaattaattatcattttatttagaatgtggttaaaaaatataaaaatttctcttttaagtccataaactccaatactatattagttaccttactaaccaagatctagaaataatttaaaatctataaaatttaatgaattatagaaattggactacataatccataatatgacattaaattctaatttcttaatagataatgattcaaagataaggtccggattgtttatggccattttatctagattgtaagatgcataacttgaatgataagattttaacaacaatagctcctattaaaaattaaaaaaatatttcttatatagttatcataaaaggtggtaatcaagtcatattatatttatcaaagcactgtctaagcaatagctacatgatactctatagtatctaagcactattctcattatctttatttctctttttaaaatttagtgagatggttgcattgcctccatctatgacttaaatttttggataacaaagccatatctattaagtttctttaatgaacatattttggctcaagtccattaggataaaaatcttttagagagcatgaaaattatatggttagaaaatgttactaaaggtgatttcatatgattcttaatgtctaaaatagtgtttaactttcttttctctatttttagtaaccaatgtcaacaaccttaatgaagcacttgaaaagatcgtctccttaataatttatattgtaagtttaaattttagttccttgaactattgataactaattgttacttcagtaactcatcaaactatttttaataattctctccatgattctcttacatgtccttttaaaatgcaacatgatatatcaatatgcttttctattagacaattcaacttctaattatgagtaattaaatatataatttttattaaaatggatctaatttttttggtttggcaactcttttgttcagcataagatcaacaattgataggtacaagaaggcatgtgccaacagttcaaactcaggtgccaccatagagattaattctcaagtaagaaagacatggcaatttaatctaaaatagatttctctgaagtccatatatttttgcctcatatgcttatcagttaaaattcttcatgctcataaaggcataaaagcaagtcagtaaattatttgtacagttgatctttttgttgtttgttcatagccttacatgtatctttgaatattttgttgatatattgattgcacagattttttttcttatttccattgattgttgcttttcttggatatatttgataggtttgattgagaatagtggattaaggtggtttacaacctttctttgagagttgtaagggtgtaaagggctagatctactaagagatgagggtgatgatactactaactattaagactatgtcggagtcctttttcttatggataacatatatttgaagttgtcattccttataatgtaagaggtaatgaaaagatttttcttgcaaattagaatcactttgcatcaactccaatacttttctttatgctaataaggtagtgaattttagtgatatcgtctaggaatgattcaactaatacctcattgcttttgaaccataattgcttttcctctattttcttttttttcatttcaatcatatttgttatggtgtaggagggaaggtatcattaatcccatattagttgtgagtcaaggaggactctgaaggaactacccatcctacatgaggtgctttttggattgaaatccaaagggataaaattttgagacctatgagccaaaacggacaatacgtaatagccgagccatgagctcttggttgcaacagtggcacactaggaaaggaatcacccttatgactgtgggatccctctcatccgtacacaaactccttgactggagggcggtaataaaataaagatgatggtaccttccgtctatccatagacttcttcttgactgggggctatattgtggcgtaggaaggagggcatcattagtcccacattaattatgaattaaaaggctgggactctaacttatataggaaggaaacactcatcctacataaggtgtcttttggattgaaattcaaagagacaatcatgaggcccatgggcaaaaacggacaatacttcacatgccaagccatgagctcttaatcataatagtggagggagggcatcattagtctcatattggttgtaaatcaaagaagatcctagcttatatgggatgggaccttttcttctctgtgacgccccatgccatgtcaatcaaagatcgaagtggataatacctcacatatacaagaacggagatcaatctacccgagccatgagcccttgactgcaatattgatgtgccagataagggacctcccctacgactgtggggcctatccctctgtacatagactcttccttgattatagagctatattatggtgtaagagggaggacatcattaatcttacataggttgtgagttaagagagactctgatttatatgaaatggaatcttctctcctctgtgaggtcccatatcatagtggctaaagatcgaaacgaataatacatcacatatgcgggagtgcagactgacccatctgagccataggctaacaatattatcatagaatcatgatttgtagtgagcattcatctactattttttttccagaactcatttcaatttatctcaattttcatgttttaaaagaaggatagatcttgcccaataatacatataatatttatgaaagtcctatgaaagccttattgtagtcagaaaacaaggtcaaaaatacattctagtctatggttgagaacttcaaccaattgactacgttgcctgaatgttcaaaagaattcaatagttcaatcaacaaatagagatgggatcatatcatctttttatttcatcaattttgctgaatgatatctataatatatatgtgccttcgctctaaaaatctttggcctaagttcagatttatgatagcaactcttcaaaaaaccaaaaattgtgatgacaactgttgcctaggcgacatgtaagtggttaagattgaaaactctaaaatagagtgcagctactctaggtaaaagatcactgacatagacatacatcaaagttcgtctgctccttaattatttcttttactaaagtagatgttgaatcataggcgaacaatactactgaacaatacatatttcttgcatacattggcttgactattagtgctatgcactctaggttcatttatacttcacaagagtttttatttgtttgccaacatcaaatttcatgcaatcaaaaacacaacttgcagaaaaaatgaataagagttaagtaaaaggacctaattatcataagctatggaagacaagacaagggatactgccattgatactcttagtaaaatagtgttataagtgatagtaatagcaatatgaagaaaagtatgaaagaactagttttttcttaaaagagtatgaaatgcatacaagttgcggtatcatttgtgaaagagaaagtattttcttttatttacgtttagtcaaaaccatatttatttgttatagctgatccctgaaatttcataactcacaccaattggcatgatgttattagcttagatttgccattataccgccattggtaagaacaaaatgccctcaataccaaaataaactgcatttgcaagttatttgaaagaagtgcaactctattattgtggcatgttaacgagcttttctataatttgaattttttgtaccgtctatgatggttatcaaattgtataacgaaggcaaaaaactatggctaaatgattcgtttttatgaattattgtatgctactcatgctatactttgtttgtttcatcatgatcattacctgcaaatcatctactcgcatgatacagctacgcatttgtcacattccgaacctagcatctgggtcagccatgcgatggcctcatattccctaaggcaaggctctaaagaatatacaaagtcttaacttctttacatcctcaaaatcacatgagcactattgatatcaatttaaaataaatatttttaattaataaataccaaactttatacaatttatagaactcaagtatctgattggtgttgataatgctccatctaattaattccttcaatcttgatctcaactataaccaaaaatacatatatcctatgactcttaaaaagaaaaggaaaagaggagatgtaagctttacaatccaataagaattttcacacaccaacactaatataataataataaataaaaaataagtaatagttgttactcttataagtcttctgtcacaagataccataataataaaacatgcaaagaaagtacatctttttatataataaatcatattaaatacttttctcaatttatagttactggattcgataatatttaggtactcgacactgaactatcacaatcatgtttctggctcatggcaagatatcgacatagtggctagtctcctaaactatcacaatcatatttttgatcagtggtaggatatcaacatgatggctaatctagagggccatatgtgcttaactctgactactacagctagattttcaatctatgatcagacactaataaagtagcttatctaaaggattataagtgctcaattctaaactatcataatcacattttcagattacggtaaggatcaatatagtggcttatcacacagactaccacaactatatttccagcttgtggtggggcatcaacaatattaatagcctaaagcaccacaacccactattcagttacacaattcaattaacaattcaagatcatactcttttgtaaaattcaatacacaagattatcgaaactactcaagttaggattagtgatatatgatacataacttcatacagatctctctctatatatatgtatgtatatatgtatgtgtgtttgtatacatacaattaacaaataagcacatagcatgcaactatcaaaaatcatataaatcaaaatcactatgcacaaaataattgttatataaatagatgatcaatgtctagaaatttttcgctctacgtactgatgacaaacttggttataactatttattagtccatgcctagcatgtccaatcaatcaatataatttcagttcatcctgaatcaaccattagcataaaaattaaataacttattgccagtgttttaatttcaaagctctaatattcgaattaatcttacttttaatttctctatactttctaattaaaaattacataattaaataaaaaatttggattttatcttgactataaactagagcataaaatcccttgctcagtatttcttaattggatgattggtcccatccaaaatcaaaatcaataattagaaagagccataaaatggttatcatcgatggtagaaaatttagaagaagaatatagctagtcgaataatagcatctggcaacctaagtgggtcaggtctggctgatttagctggttattcatgaatacaacaaagatcatctatgatagattttgaggttgcttgatcaagaccaaggtggagaaaggcaatgctagtagcatccagtgactagtgttagcccaatatacataatccaaatgattagtctacaaatcaaaagccaaattatagctcaataggaatttggtgatgataaaatcaaacaatgcttagcagggtcgggtttggagttaactattatacagaacaagtccaaaaccttcttctaggatcaacatagggtctactatcaagtcttcaaaatccatctttttttcttcttttttatccctaaatataagaagagagagaaaaagatagaggaagaaagctggtagaaagagatgtgagagagaagggagaaaaaaagaacaaaccaaatctctctctttctctcttcattatcttctttcttcaaaaaggggattttcccctttctccctctctttctcctagcggatggctaaggccagcagtctatggtggtgtctagtggtgaagatgcgatggccgcagtgctacagcgatggcagttgtcggttggtagtggtagtgggcgatccaatagaaagaaaaggaaatcaaaacaaaatagaaaaagaagccttgctttgatatgataagaagactacaaggtggtcagcggtaatgacaagcatccgcattagcttaacctcttatgatagttgcaaaggcaataatagccacagtggctgacggtggataaactaaagaaaacagaaggtccttagtgcggcaacatccgacggtcttccaagaagatttcagccaatgatggctgtatgaaaataaaaaagaaaaaaaggtaccaataagatgggaggccacgatgcctcgatcatctctaatgatggcgtgaccatggttgtgccaaaacttttttttcctatctttccagtgatatgatcaattgatcactgatcaatacagtggaagcttggctttataaatgatggaggctagggttttctagcctccgatgagttggagaaggagccagagtcaaactctttcttcgactcaaataggggaagggaaggtctttccttccttcccattgtttcttgggcttgatgagatttttattttagaaaaatttcaagcctctacaaccatatgaaatcataatgtcaaagctagaaaaggagatctatgccataatattccaattccaagcctaatcaaagaaccatcaatccattaacactaactttaagatacctaagttctccctagcattatctatggtaagaaaatctattaattaaaattgcataattatatctaaatcagtcaaagaacaaataatattctctctttctttatcaaaattatactcctttaccaggaaactaattcgaatcttccataatatcttttggatcaaagaattaatgtatttaattagtttcaaaataactcaaaccatcacacttctgctatacactctaatctaaatccatcgattcctctgggttgactaggtgaattctaacaaaataccgcttaatatcggaaccaagaagatccaaaattttaacttaaggcaaactagaacaaaacttttgcatctttttatccttacaaaatcttgagcataccacatcaaaagtaaaccttgagccactatccatgtttgaagcatgacataagcttcgccatcctctcaaaacttaataactctagataaatttaaattaatcctgacttctctaacagttcaattagactatcaagatcaccttttctcttggaaagttaactcaaaattctaacaagttagaaaactctaaatcaacattcttattaacttgtttattttttatagagcttcgttcactacaattcttagtatcaatcgacaaaccacatgaacgccccttatatgttagacatatacaagtccaccagaatcaatttctctactcaattaaatatcgatagcaagatactatagacctgctcataagcctaactctgattagaatttaacacatccaactatctccaacaaatataagaaagaccaagtaagctgatctaaagatgataatttaaattatcaaagattctaccaagatgcatatctcatatccaattgataaaatctaatccattaatagaatcaaacatacttttcttttacatgccagtttcatatatgatcttcttataggtttgattctcgaagaatgtttatttttaacactatgtaattctttcttaggccatatcctaaacaacttgctagtaaagtctaaaattttaatgatcaaacaattaataataaaattaaaaaagttattatgatctccccctatattaagtttagaatttcaaaaatatctaagtgacaattgagcaagtacacacagcataacacaatctaccaatatatcatactttattctagggtctacagctcctatacttaggtcaaatcttacttattgaaattagagacataacttatccattccttttgtactcataatatgccaagtcttatgcataaatttttatcataatgcttagtgagcttaaacctgagctttgaatctatttctactatgtacattacatccctagtgatcacaactttaagttcaaatatcaattaagttataatccctaataatcataacctagctctgacactactttgtcatatctcgatcccagcatctggattggccacatgatggccgtatactttctaggacaagatcctaaagaatatgcaagattttaaattcattacaatcttaaaatcccatgagtactattgatctgaattcaaaatgaatattacacattaacaaataccaaaccttgtataatttataaaatttgatcatctgattggtattgatgatattccatctaatcaattctttcaaccttgatcccacctatagtaaaatacatatatcctattactctgaaaatgaaaagaaagatgtgagcttcatagatcagtaagaattttcacacatcaatattaatataataataaataaaaaattatcaatagttattactcatataaatctcatacaataggatatcacgatcataaaatatatataaaaaaatatatttttttgtataataaatcacatcaaatacttttctcaatttatagtgtatcagatcctataatatttaggtgctaggctctaaattattacaactatattttccactcatggcatgacatcgacatagtggctaatctcgtggactatcacaatcacatttttagcatgaggttggacataagcatagtggctaatctagagggtcataagtgctcaactctgactaccacaatcatatttatagtccatattgggatatcaataaaatggctagttcagaaaactacaagtactcaactctaaactatcataaccattttctagcccataatgatgcatcaacaaaatagcaagcctagagcaccacaatccaccattcaaggacacaattcaattaataatttaagatcatatttctttgtaaaatttaatacataaaattaccaaaaccactcaagttgggataagtgacatgtgatatataactttatacagaatcatatatatacttaagaaataaatgtatagcatataactatcaaaaactatatagatcaaaatcattaattcacaaaaataatttttatataaatagatgattattatccagaaattcttatctctactaatgacaaactcggttacaactattttcttgtccatgcctaatatatccaaccaatcaacataattccaactcatccttaatcaaccattagcataaaaaataaataaattactcatagtgttttaatttcaaagctttaatatccaaattaatcttaaatctaatttttttgtactttctaatttaaaattatataattaaataagaaattaagattttatcttgacttgtaaactaaagcataacatttcttgctttgcattttcttattgggatgattgctctcatccaaaatcaaaaccaacaatcaaaaaaagctataaaatagttattgtcgatggtggaaaacttagaagaagaacagttggtcgaataataacatccgatggcccaagtgggtttgatctagatgccttagctagtgattcaagaatatgacaaagatcgtctatgatgggtttcgtggttacttgatcaagatcaaggtgaagaagggcaagattagtaggatccaatgaccagtgtcagcccatctaggtgatccaaatgattaatctataattaagagccaaattatagctcaatagaaatttggcgatgataaaatccaacaatgcccggcaagagtcgggttaggagtgaacaattatagagcaaacctagaatcttcttttgggatcaacctagggtctaccatcaagtcttctaaatctatctttctttcttttttttttatgcctaaatccaagaagagagataacaataaagggagaatgtagagagagatgtgagagagggaagaacaaatcgaatctctctctctcttccttgtcttctttcttcaaatagaagattttcctttctccctctcgtcctccaaacatggcagtggatggctgaggccaatagcctgcgatggcatccaacagtgaagaggcgacaaccccagtagcaacaatgatggcagctggtggcagcagtgggcaatcggatataaagaagaagaaaatcaaagcaaaataaggcaagaggccttgctttgatccaatgaagaggacttcaaggtaatcggtagcaatggtaagcatctgcaccagctcaacctttggtaatggtcgcaatggcaataatggccatggtggccaatggtggatgaatcaaagaaaataggggatccttggtgcggcaagatctaatggtctttcaagaagatcttagccaacaatggctacacgaggataggaaggaaggagagaaagtgcccatgagatgggaggcgatgcctcatctcctatgatggttcaaccacgattgggctaaaacttttttctcctccttttttgacaatgcaatcaattgatttctcaatagaatggaagctcagctttatagacaatggaggctaaggtttcctagcatccaatgagtttgagaagaagcaggagtcggactccttcgactcaaacaaaggaaaggaaggtctttccttccttcctattgtttcttgggcttgattttgggcctatttcgatgatgggctgggtagggtatcacaacagttttgtttctaaattgtcattatcaggaagagtaattctttgtacaccacattcgatgtagaaaaactgcaccactccgcctaattgagccacatataaccaccacttttcaatgtaatttagtattcgcaattctgctttttttttttgaaattttgaatggcaaaaatgtccatcctcttttaaaaaaatatgatatcttatggccatattataatatcctgcaatcaaattatgatttcttatatacagaaagttataatttgaccacaggatgtcataagaaaggggtggacattttcatcatttaaaaattttaaatttttaataatgaaaatgtcctttcctttttatgacttttggaagaaaaattatgacatcctatgtgtattaagacataatttgaccgcaaaatgtcataatttttttaaaaaaggataagcattttcatcatgcaaaatttcaaaagaaaaagcagaaatgcggatattaaatacacattggaaaacggtgcattacatgactcaatcagatggcgcggtgcattttttctacaccaagtgcggtgtacaaagaatttctcttactaggaaatatcttgagtctagaccggcccatttgtcatttagaccaatcaaggactatgaattttggtccataataagtatgagatcgtcatgggattgaaaaagatgggaaataactcctcagtttgccccttgacagctcacaattcttcaaataatagcataaatcattttttgaatcatcaaatttattacattttagccttttagaagaaaccaatgctatccatataaaaggtatttgttttctattaatgtcattgcactaatgaagacagcttcagcaaagatagagcagaaatcctttaaattttgtaagattcatttgatcatcttgaattttctttgatgatgtggttgcagcaatactatcagcaggaatcagcaaagttgcgccaccagatacagattttacaaaatgcaaacaggtgaacctcaaacttagatcagaactgattggtctcaaatacaatgtatatgcattttcaaagcttaagattatgtcttaccatgattcctaatctaccacctctacctttcaggcacttaatgggtgaagctttgagcactctgactgtaaaggagctcaagcaactcgaaaacagacttgaaagaggtatcacacggatcagatcgaagaaggtaatctgcatctatattttcttcaaactgagatcttcatattgccaccagcacatggcttatctgaagtacatgattattaatcatgaaacatcatgctatgcagcattgaaaagggaaatcattgtggttcacaggtgggggtagagcatgtaagatacgatgggatctaaaaatcgagtcaatataaataagtgtaatttgtattctgttctgcccccagaaatcagcataggcaccatgatgcatgtaccatcacctaataatatgcaacttcagaattttttggcccatccagctctttaatttgatttttgatgcatctcattgtttttttcgcatcagcatgagctgttgtttgcagagatcgagtatatgcagaaaagggtaatattctaaacttattccctgcaacttaattcaaagtattgatttctttcattcatgtctccctctgagtggttctttgttgttgaactgtaggaagtagaactccaaaatgacaatatgtacctcagagctaaggtatcaatgagaacaaaactctcttccttgtccttgtctgctatttctttctgatataaacaaaagaaatggatatcatattcgtaaaatatttgatatcatctatcatgcttttagacttatatgtggtactagcatggagccaaattatatgcattttcatatgtttagaatgcatgactaacgaaacagtgacttatgtttaaaatgcattttctcattgatcaaatttttttttacatactgttgaatttaacagaggagaatagtttccaagagatattacaaaacaagagtttatttgtatttgcttgtcttcaagaaatgaattcagctccactagtggtaatcatgtggtcatcatccatagtggcctgtatggcatggcataaaaactaggtgagattgtaaacaatcttcatgatgatagtatatatatcatagaacattgagcctttgtgtggaggctcatctgaaaattagtcatatctgaatgagaaccagattgatggaccgtttgaatcaagagataggacaagcaatactcgaaaaagtgccttagttacagcccaaattctggattgctgatttctctatttatcgatgcaccaacacccttcatgggcaagaatattgtttaaatcagtgttgcatttgacttcaaacctctaacatctcaacaaccataactgaagccccttcaaagctaaaatgcctgttaatttgttcttcacaaagaaaatggcattttttcctagatgtccataccgatactaacggtattttggaggcttgatgatgtgctaatgacactttggattcctcaaagaaatggctcctctgctccatctcggtcacaagtctctaaaattttcacttgttgtttccattgattctatttctttatattttatttagatcttcacagacacagtctcaaagtagcaaggtggcatctacattcttatttctcacttcaaaatttttggtgttctcagatagcagagaatgagcgagcacagcaagcaggtattgtgccggcagggcctgattttgatgctcttccaacgtttgataccagaaactattaccatgtcaatatgctggaggcagcacaacactattcacaccatcaagaccagacaacccttcatcttggatatgaaatgaaagctgatccagctgcaaaaaatttactttaagtatgtcgctgcttgttaatgacatgttctaataacataggctacaagacctgtactcttactgataaaggtgtgttagaagacttgtctgatttctatattcctaatatcaatagacatgttagtgtgccttaatttgtcttgatttcagtaatattttgcagattggaagaaaaagcacttttttattcatagaagttctctccaccaaccatcatctattgagtagatcagagtagcataaatgacatgtgtatgcatatcctagagctataattgacatgccaaatgaaaaacctaaaatgctgaaaggaatctccacaattatggaggaattagtacttcttagaccacgaagctaaaactagatctgcaatcctcataaagaatggctaccccctactgccgagtgtcaccaaaacattattgaagttgctaagccaagccctcaaagttctcttttgctatgtttctccccagctgcgagcttttgattttgttgcttcttcaaagatcatgtacatgtaagtggtttcttttgctgctgtctctcggatctttttgcgtgatgcatataggcctggtagatcaccaaaaccagactcgccatttgtgtaagtccaggttttccagtagtcctgtgattcttgcctccagctaatgctttagcagaccattgcaagcaaatctctgtcagcaactatatggtcacttggagtagatggatattaaacatgcttgtctttttgcttatagccttcaatttatttgatattatagtattaacccaagctcaagctcgactcgatgaaaaatagacaaaactcgagttgagcttgaatatcaatggagttatactcgagttcgagatcaagtcttagcttactaataagatatatatatatatatatatatatatatatatatactaactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttactaataatatatatatatatatatatatatatatatatatatacaaactcaaataggctcataagttttttaaactgagtatcctgttattcaaggttgataataatcgagttgagtcaagcttgaatagtttataagcaactttgactcatttgtatacatcgtaagcttctaaagatagccataagagatcagagatgtccatgcctgtggtaccaacctatggtaagcattaaggagggtggtaccaacctatcggctgaagtttcgttggtgaatgttaatttttgcaaatctctaacactataatataaaaatctctaggatcttacatggtcaaaaatggttgtagacgttatatgctaaataatgtgttgttgtccatgtcaggatctaatgaagaataaccacttgttttgttgtgagaatctaatcagtgtagtgctatacaagccaatgatctgtatttaattagctcccagttgctagatggaatcgtactaaagtttttttttttttggattgaaggtactaaagcatttaaaaataaaaaatttctcacaatccggcattagcttagttggtagagcagaggactttagttggtattaatcagcaatcactaggtcgcaggtttgaattcggcaagttagattttttaaattaaatgccaattatttgtagttttttctaaacaatttgacactatttttcaaaattatgcaagacaaaaattgaaaaattccaaggtgtcatgttatcctttaaaatttttacatcataaactttaaattataatttacaaatatttatttcatttacaacaacagaacatatagcatgagaagaattatgcaaaagaataactaagaatttctgataaaatatacacctttttctgaccccaatttatatcactaaattcaaagatgaggattatgcaatgttggagctagtatggctgaaaatctaacatccttgctaagcatttctgctttaggaaggctaatattcttgaaaaaacaaaataattggcttggggtttaagacagcttcaaactgggagtggcttacatgtatacaatcagaactactataaaagccatggaagcaggatgggaaaaaagaaaatgatttagtaattttttatttatatttaattttttttattaagctatcaactatttccctaaatatcataagacccacatcaaagctattaaaaacaaataaaggttttgcatcaatgtattgggtacatcccaatcttatttctcaaaaatgtttttgtgtcaacacatctaacaatatcattgtcaaacttttatataaagcacctactacacaagctatactacactctgcaagttaaacccatttatttatcaattttctgccaaattatttattaattatttaaacaaaaaatttaaattactataatgctaaacaattttatagctacttaaaagaagcatgttcggttgctaaactatctcacttgcacatatcttccgtatactttatatcattccaaatttttttcataggacttatttggacaatcgggaaacatgttttctttactatgaaattgcattcaagagtattgacaaatcccattgtcttttttattactaaatatgcattttgtatgctcatatactagtacataaatctattggttttttattctcttggttagtataaattgactatctcaagatagcaattaatatgtattatattattcaatacttttaatcttgcctttgctatgccgcttttagtttctttaatattaaatatcaaatgaaatgataactaatctcattttagtgatattgcctgacattttgatatcctattcttcaatatcacttgagatatcaagatatcttgactatttaagatctattttctattgaaatgaaggtaaattggtatgttggtttgtcttggttagaaatgaatttgagacttaaaatttcaatagaatttgatgaatgatttaacctgaatatataaaaacagcacgcaagttagctgatattcatccttttgatcttgtttcaaattatttatcgggataattgatatttatgtatttataaaacaatattacaggtaagagaaatcaaaatacaatgattcactccacattcctatcctccacatccaaaactcctcaaaattaaaaccaaactctaaaatgctctctatatattaaaatttcaatgtagcttttgataatgttataaaaatagttgttttgatataaatggttgttgaagctcatatggatgatcccttagaaactggagtgtattataaatgatcgttgaagctcgtatggatgatcccttagaaactggagtgtattataaatgatcgttgaagctcgtatggatgagtccttagaaattgatataagaaatattatttccttcaaatgaaaaatattattcccttggtaaataaataagaaatattatttcttttgtaaataaatgaaaaatattatttttctttataatttagattaaaaatctataaaagagcttggaatgaaatgagaattgttgcggccaactctccgtcgcctgtcgccggtaacgagcacccgcaagacagcatccacatagaccgaattgatgtccgacgaagaccctccgatgcttaagtcagataaggaagttgatgaacaataatttttgaatgtagaaagtagcagagttctggccctgagatggcttaccagtactgctcacttaacccctttttatagatgcttttgatgtaaccgtcgagcacatagtcccactttttatgacgctaaattatcgggccataaatataaaattaatgaggcgttaattctccttaatagccgtgacacacagttgataaccgtttgtgacggttatgatatgttgagcagattagccgatcatatatcggtagaaccgactatatgtcggtagaatctatgagcgaccatcggctagtagttctgttatgccgacggtctaagtcattcactgtcgatcggtagtagtcgaatcattagtcggtcagccgatagtaagtcggcgcggttcgctcagtcggtcgatgaagagtcagaactgcatgttcaaccgatatgcagttggagtcgtggtgaccaaagtctgaggtcggtcagtttaccccaacagttacccccactctcaaagtccaaggtgaaccgacgtgtatattgtcacgtagttcgtcatattagatgaagggagttatttctatcatatcgaacctcgattttgatgtcgctttcttcgagatatgggcgatcgactgctttgtcgttgtggcggatacggtcatctttaaactgtcacactaatcagacgattcggtatcagttgtcagtgtcagacatcattttggaaaatcaattcgacgtcggatgatatgattctgacaaatagatttgtgccatatgtctgaatgttattgggtcggatctgtttacgcggattaggatgacgtggctcgatctggggcaaatacgtcgaaccatctgattaatggtcggtctagatgttgccacatgtcacatctgataaattttcgattcaatcaccttcatctccactgttgagggatcctatatatataggatcgctctcaaccaaacttctacttttcattttatctttcttggtgccgaaactctgtcggacagtcgtcccaacgtctgaggttgttattttcgtctttttcagatcaagtttctgtcttttcttgagtcctttttctttcagaatctccgtcttctttagaatcttgtctcttatggctaggacttcttcttgggacggtcggttggagaatccgactgacgaatctcaatcagatccagaggttgaggtttcttcacttttggagtcaaatatcgagcagcttcaggaacagtattgtatcccggagcagtttcagctttttgcccctagggctgatggtcggatgaatatcccttttttgggccaggtggccttctatgtcgaagattttcgagtggatcttcgatttttgattttaaaatttatccgaaatattttggattactacggactttgtctggctcagctggcaccgaacttgatctggctggtaattagttttgccttgttgtgtcagttgctaccgactaaacctcgtccttctctttttcgagttttcttcatcctccgacctcatccgaagatccgagggtggtggttcttcaaccctcgaaaagatttttcttttattactgatcttctatcatccattcatagatggaagaatcaattcttcttcgcttcctctacccttccttggggttttccttctcgttggagcgatctacgaactgattgcacgacaacagccgagtagagattgacgatcgggaggacttccattgactgaaagacatgacggtcctggcacagaaggagcttgtgaacgaacagaccctttatgatgccgaccttagttcgattgcccgattagatatagtacagtcggtcggttatttcggactttacttttcttttacttgtttagttgtactgacttctattgtaattgcagccatgtagccgagggtgcgagtgtcgagcatcgatatttgtcagcacgctgccaggaagagggcagcgtccgaggttggaccttctcgaccatcgatgaggcatcatactttggtgcaagttcgagcggcactagcttcagtcgtcgcttcaatgccgactgaggaacccgatgctccatctgcatcggttcctgagccgatcccgatactatcagccccgacagtgctccctgctgcatcatccgaagaaagggtggcaaggagaactgccgaagcaccatcggtagttccatcaattgaggaggtttgggtcagggctggagaatctgaacaatctgtggctgcgccagttgctccttcagctggggcgcagtcgagttcaagttttccctcgctttcgaacatgggactgccggcaagggatcgggggaaagctctggtgacttcgacggaagatgcagcatcggagggctacacggttcacttcgaccttcaagtacctgatgataaattgaccctggccaatccgacattggccaagcgactgtgccaagccgctcttccttcgctttatcaggagcatcgaaagaaacggacagtggccgagatgttttcatccttttacttgatgataattagggtaagtttcttttcttctttttttcttttttttaacctaacttatcttctgcttgcagttgatctacgatatgtttgacctggaagtcgcctatgcgaaggttgataattttcgtaggtcgtagatgaataaggtggcagccgtcgatgctgagaaagcggccgcactcgaacaacttaagtcgacagcggagcgggaagccaagcttcaggaggagattttccaactaactgatgacttagcatccttgggggccaaacttaagttggctcgtgaggctatttcggctcttgagtcacaggtcaagagcaaaaagcactctatccatcggcttcgatgggagcgagacggatgcatcgaagaacttaaaatcgaacgtggatgtcattgggccagcctgaaaagattggcactggctgaagaagagtcatcctctgctcgagtcgatgctgatttggtgaaggcggaagcggagtcggcaagggaggtattgagtcagacaatcaaggatttttggagttcgaaagaattcaaggaagagatcctcgaaggtggcttcacctcgtactgtgtcgggtatgaagacggtcgagatgcggtcagagaattatacccgaagctcgacttgagcagtatcgtccctccaagatcggaagatggggttgttgaaaaagaagccgcaccgactcaagatgaagcactgactgtgcctgaagttattcaaattgccaatactacaccagagcaaaggaataagaacggtgatgaagcttagttgatgtatttcgctttcctttttgggtaatcaaatacctataatcggacttcagtccaattttgtaactttttttgacaatgaatgaaagtattttcttctaagtttaaactgtttgtctagattattaagtctgcaatgtctgcaatgtaaagtagccatcgaatattaatcggtgatccgatcattcgatagaacatgtagaatatccgttagtcgcgtaatctttgacatacttaatagaagttaggataacgatggtaagtcgaatatcctatacccgatacttgatcgagtttatatgtcagatcatttgataatcggtggcaagttgaatatccttcgactgaccgtagccatgtcagtataatttcaatccgaccttgatcatttttgtatttcattctgcttagttaagactaagtcggcatattagtctttcgactgtagtcagtttttatagtggaaagccaacattaaaaatcaaaatataatcggtactacagcttttgcagtgaaagcctatatatttgatgtcggtttgaaattacagtcggtatgtcagtttttgtaagagaatcaaaatatagtcgacactgaaacaattgattctctggcgtttacagtgaaagctgaaataaactctatgtcgaagtacagtcgatagtttggcttttacaataaaaaccgacatataattaatcattgatagaacttgaccaaggtttctgattataatactgaagattctgtattgtatttcaaataatatatatatcaacaactttataggtgatacatcttcagattgtcggcatttcatgttcaaaaaattatcgatccttcaaggatttctaaccgatatgcatccggtctaagagtttcggatattctgtaaggtccttcccaattcggagacagtttttcttgatctaaagattttgagatttcagcttttcttaagaccaaatctcttggttggaagaccttcggcttgactcttgtattataataccgggttattctttgccgatatgcagccatccgaacttgagcttgctgtcggagttctgaaaggagatttaagtcggctcttcgatattcagaattgctcggctcactgtattgttccatccttattgatggcaatccaatctcgagcgggatcattgcttctgttctataagccaaattaaagaaggattctccaatcagtatccagagagttgttcggtacgcccataagatcggatataattcttccacccagaggcctttggcttcattcagtcggatcttgagttcgtacaagattattcggttggttacctccacctctccatttgaatgtggatggccgactgacatgagtttgtgtgtgatatgaaacttcatacaaaactctctaaaatttgattgtcgaattgtcaaccattgtcggtgatgatggtgtgcggtaaatcaaatctataaataataaatttctaaatgaagtcttttattttattttcagtgatttgagccataggttcagcttctacccatttgatgaagtagtcaatagtaatcactatgaattttctctgatcagatgccggagaaaaaggatcaaatatgtcgattctccattgtacgaagggctatggtgctacaatcgatgtcaactgactagccggttgatgttgtatatttacatacctttgacatggttcacacctccagacaagttcagctgcatctttcttcatggtgggccaatagtatccttatcgtaggactttataagctagagatttatctcccaaataattttcacaaatctcttcatgtacttctctaagtgcatagtcggcatctgtaggtcccaaatactttagcaagggaagtgaaaatgaccttttgtagagatgactattcattattatatattaagaggccatccatcgaagtcgattggcttctaaaggatctacagaaagaatctcatcagtcaagtattggacgatcggatccatccagcttggttcgatagtgagctgcaatacttcctcgactttgtcgatacttgactgttcgaggcattcaacgaatgtccgacccagtgagttgaaagcggtagtagcttatcatgaaagtatgtcggctcgagtatttttgattctgaaaatatgaaagatcttgaaatatttcaagcttgctgtaatatctttcactttctaaagatactttatcatagtggggtctcaggcttcaattcacccttgacttgtccaacaatccattgtgagtcggtgaagaccttcaaactgtcgatctcaagctctttgactatcttcaagctgactaagagtgctttatattcagcttgattatttgaggctttaaagttgaaccgaaggacatattcagtgactactcctttgaaatttgtgaatataagaccggctccactatcttgtgtattagatgctccatcgatgtgcagcacccaggtcaaccttaggtcgggttcgggagtcgtaacctgctttattatattagcatctgtatcatctggcttattgtcagatattgtacattctacgatgaagttggccagaacttacgtcttcatggatggtcgtggatgatattgtatgtcaagctcgccaagctttactgcctacttcgtcatgcgacctgacgtatcaggtcgatgtaagatcgtcttcaacggctgatctgtcaagaccataattggatgtgcttgaaagtacgaacgaagtcgttatgtcgatatgattagagtgtagatcatttttttcgttcttgagtatcagacttcggcattgtgaagtactttactggtatagtagatcgatcgatggattcgattttcatcttcttggatgagcaccgaactaaccgcttctgttgaagtcgccaagtagagatacaatatctctccgaccttcaattttataagtaaaggtggagaagtcaagtattttttcaagtctttgaaagactgtcggcattcatccgaccataagaagtcctttgtctgtcataaaattttgaagaatgacaaacatcgctcgactgatctagaaatgaatcgactgagtgcgacgatccttccattgagttactgtatctctttctttgagctcgggtacttcatgttaatgatggcctttatcttttcaggattagcctcgattcctcattgtgaaataagaaatttgagaaattctctgaaggttaccccaaatacacacttgatcgggtttaacttcatctgatatcgtcgaagtgtgccaaaggctttctccagatctcgaatatgatctgaagtttggagactcttcatcagcatatcgtccacgtacaccttcatatttcatccaatctgggccttgaagatcttattgacgagccgttgataagtagctccgatatttttcaaactgaaaggcattactttgtaacagtatatgcctttgtcggttacaaaagtcgtgtgctcctcatcttttagtgccatccagatttgattatacccgacgaaggtatccatgaaactcaaaaatcgatgacctgaagtcgcatcaatcagttaatcaatctttggcaatgggaagctatctttcagacaagcttcattcaaatccgtatagtcgatgcaaattctttatttttcattggcttttctcaccgttaccacattggcgagtcaatcgagatatgtagcttctctgatgaagcctgctgcgagaagcttatcgacttcatcatcaatgatcttttgtctttcaggggcaaaaggtcgcttcttttgtcccattgacttaacgttcgggttgatgttaaattggtgagttattacttctgaaggaatttcgggcatgtcagtggccgaccaagcaaaatatcagcattggctctgagtaattttattaattattgccgctctgagtcggacagttgcgatccaatttggattattttctggggatctttttctttcagcgagatagaattcagttgttcagctggttcatccttttctgattctctctttggtctaatttatcgatagacaaagagtctttagacttattattttgggtggagacaaggaagcagcatcggataatttattgatctccatgcatctctctaactctattttttgtcaaaaatcagactaataaatggtatgtcgaaatcactgctttcagagcattgagtctagatcatccgagtatggcattatgagccgaaggtactcgaactatcgtgaacgttatgaagatggtgttctgttgtggttcagttccagcgattaaggggaggaagattttttcttccactgtgacagcatcttttgtgaagctgactaatggcgtcaagactcttctgagtcatcagtcggtagtcgcattcgagagaaagtcgaataaaatagaacatcagttaaacttttattatctacaataattttttttacatcataatttgctattgttgtcgagacaacaacagcatcatcatggggagtttgaattctccaaacatcctcttctgaaaaaattattacattgttgagtcgtcgtcgtttcaccgactcttcttcagtagttgccctcaagtccagtcgttcggagatcatgttgatcactcctgcagtcggctgattatttacagcttcctcagtcggctgaggtcgtcaatcggtaggaggttgagttggcggatctctccgatattttttgaagtagcctcattaaatcagggcttctatctcatccctgagttgaatgcattattcggtatcatgaccatgatcacgatggaaccgacaatacttccttcgattgcgattccttaatgatgctttcatcggtggaggatgtcgtaggtattctactccttcgatctccattaggatctatgcacggagagcaaaaagaggagtgtagaagtcatacctgctgtaattcagccttggactccgtcatccgggcgaagcttgcttattggatggcggccgacttgattcagccagagcttctcccttcttttgtttcttcttcttctaaccgttgccttttgtcgggcgtcggccagaagctccttcgtctatgtgcatatacttgtatgcacactctagaagtttagcataagtccagaggagagtcttgtccaaagaatatgagaatcgagatctcctcagacctcttttcatggtcgatatggccatgtcttcattgaggtccttgacctcaagcgtggccgtattaaaatggaccataaaatctcaaagtgtctcagtctctctctgcttgatcgagaagaaattatcagagatttgtgacggccttcgactgctactgaagtgagccacgaaagagtgttcgagctatccaaaggagtatatacttttcgattgaagctcgaagtagcagaccaagcagctttctgaagagtcgctggaaagtcgatgcacaagagggcgttggtcaccccctgaatcatcatgagagccttgtagctctcaagatggtcgatcgaatcagtggagccgtcatatggctccacttacagtattttgaactgagatgggatcggctcgtccaagatgtgtcgagagaaaggctggacagtgtgaaagtcatagtcgttggaggacttccgatctttcacctgaagctgggcgagtcggcaattgattttttgaaacttgtattcgtagtcgtcaaaccatcattgctggaaaactctgagggtagaactccctgacgagcttgagggagaagcagaaggtatccgcgatcatttttccttcctaatacggtcgagatgggaaggagaggaatgtcgcgagtggtgggtggcacggcaagagtgccgagaatgccgctattcatctcgatggaagagccaagatggtcgctctagagaaggagaaggtgatcgtcacggatgacggtggctgtgcatggacggcaccgactttgccaccggttgctccgtcggcaactgctgctgggtttgctgttgttggaggcttttgactgcctccataagaacattcatttgctgcacaagcatagtgatctggacatccgtaatgatcacgggacgtgaggaactagactctgctattggaagaggagaaggaacctctttttgatgggaagagtgcctcgctgatccagttgcagttgagtgttgggctctggtcttcgtcatggtgtgtatgatctttaccccttcctgacataccaatctgttgcggccaactctccgttgtctgtcgtcggtaacgagcatctgcaagacagcgtccacacagaccggattggtatccggtggggaccctccgatgcttaagtcagagaagaaagttggtgaataatagtttttgaatatagaaagtaacagagttctgacctcgagatggcttaccagtactgttcacttatctcctttttatagatgattctggtgtaatcatcgagtacatgatcctattttttatgatgctaaattatcgaaccataaatataaaattagtggggtgtttatttttcttaatagccatgacatgtagttgataaccgtttgtgacggttatggtattttgagcagattagccgatcatatatcggtagaactgactatatgtcggtaaaatctatgaatgaccatcggttagtagttttgttataccgacagtctaagtcgttcgctgtcgatcggtagtagtcgaattattagtgggtcagtcgatattagtcggtcagccgacagtaagtcggtgcagttcgcttagtcagtcgataaagagtcgaaaccgcatgttcagccaatgcacagtcagagtcgttgtgatcaaaatcaaagatcgatcggtttaccccaacaagaatgattattatcgtgtaaaaagattttctctctctctctcattctctcattgtgtctctctcctttcattatatattttattattctacaacacgttatcagtacaaaaagttttccaatctagtgctgcaaggtgtctccaagtagaaggaagtctcaaatttgaatccactttggtttgtttttgaaggtatattttaagttttaattacattttttttgaaaatattaaattctcacaatctattgggttaatcctcctcctcaatctctactaagggaatcttgaggattacttccagaagccttcacaggttattcggttgtagattagatctataaaggacataagttatggatgtttatttactttataattttcaatttaaatatgatgaatctggtaaattggcaattcactgcccttgatattacgggcaagaattacctatcttagattctggatactaaaatgcatcttaatgccatgaattttagaaccatgattcaagaaggaaatattgcattcctgcaggatcgcgcaaaatctttaatttttcttcagcatcatattgatgaaggtttaaaggttgaatatcttactataaaagatccactagtattgtggactaacctgaaggaaacatgtgaccaccagaggatggtcattctttcaaaggtacggcatgattggatgcacttgaggttgcaagattttaaaactatgtctgaatataattttgctctattctgaatcagctcacaattaaaactgtgtggaaagaatataacagatgaggatatgttgaaaaaaatattctctacctttcatgcctcaaatatgctcctacagcagcagtatcgagaatgcagatttaaaaaatattttgaactgatttcatgctttctgatagtgaagcagaataaagaattattagtaaagaatcatgggtctcgcctaaccagctttacatcattccctgaagtgaatgctgtgtcatcccaaaataatgagcatgggcatggatgaggtcgtgggcatggccatggtggtttcaaaaatattgggacaagctacttgaagtagtaaaatctaaaaataggtacaagctctgatcaagagaaaaagatacagtcagatgaaaatgtttgctatagatatggaatgaaggatcactgatcgcatacctgtcgtatgccaaagcatctgacagatctatatcaagcttccataaagagaaggaaaagaagcttgagacaaactttacagatttgtttaatgatgatgatggcaatccaaatgtgcctccttttgatgtcttcgatttttttgcctaccctgaagaaaaaattgactacatgatcattgatggagaaatagttaaagaataatttttattgtatttttttttgataaaattattttatttatatacttatattttgaaattaataaataaattattttataaaattaatatcttatttattttctagattaaatctgaaaatgaatgcgaaagaattttgcatagttgatagtgctacaactcactccatactttgggatcaaaaatacttttcacaatcaacctttacaaataaaaatataagtataatttttagtacttctaatataattgaaggctccagaagagcaactataatactgtcaggtggtacaaagttagaaatcaacgaagctttttactcaacacaatctaaaataaatttactgagctttaaggatatccgccaaaatggatatcatattaagtctaaaagtgaacatagaaaaaaaaatttgtgcatcattttttatgattcaaacagaaaacttgagttaaaaaatttttttgttctttcgccaggattgtattaaacgactatttgtgcaattgaaataaatataatattgaaccagaatttcactaaaaaagaaatgtttattctctgacatgaacgatttggtcatcctggatcaatgatgatgtgcaaaattattgaaaactcaaatggtcatccattaaagaaccaaaagattcttctaattagtgattacccttgttctgcatgttcatttggaaaattgatacataaactttcattcacaaaattagcaattgaatctcctacattcttggaaaggattcaacgagacatatatggtccaattcatctcccttgtggaccatttagatattttgtagtcctaattgatgctttcataaggtggtcccatgttttgttgttgtctacttgaaacagtgcatttgctaaattgcttgctttgataatatggttacaaatacaattcttcgattttcctataaaatctatctgattagataatgcaactgagtttactttaaaaatctttgatgacatttgcatgttagttggaatcaatgttgatcatcttgttgctcatgtgcatactcaaaatgatctagcagaatcatttattaaaaagttgcagcttattgctcgatcattattgatgaaaactaaattgtttgtatctgtttgaaggcatgctattttacatgctgcatcactgattcgaattagaccaactacttatcataaatattctccgctataacttatagttggtgaacaaccaaacatttcacatttataaatttttgattgtgctatgtatgttccaattgctccatcccaaagatctaagatgggacctcaatgtaaacttagagtttatgatagtttcgatagtccatctatcattagatatcttgaaccactgacggatgatgtattcacagctcgatttatagattgtcaatttgatgaaatagtatttccatcattagagagagattaaaagatgccagaagcataatataagttatcatagaatgtaccaaatttatcatttcttgattcaagaacaaattagtatgaactagaaatttaaaggattctttatttgcaaagtatagcaaataatttacctaatgcatttatagatacaagaaggatttgcaaatctcatattctagctgaaatactctagctcggataaaagtttcaataggacaatcgatccctacgactgcagaacaacctacgccatgcttaaagcatgaaagatcgcttagtgcacaagataaaattctaaggaaaagaaattcaagtaaagtggtacatgaggaaaatgaaacttttgaagcaagataaattattgatgatgtagattctatggataacctattgggaatagtgtcccaaagccaatcgtcaacctgttgacgattgtgctccttttgtattagtacataaattataaataaataaaagttactttggtattttttcatcataaatgtttcatcttctaatgaactcctgtgttgtggtgaagtccttgggactatttagactcgataaaggaagatttgtcgcttagtccttaaacctgtttgcgaccaaatgatacgttgttaccaaggatgacaacgtttatcgagcataggtcgttgtgtgccatatgggttggttgtcctcataaccaaggagtgtggagatactgtatatggcatacaggtgagatataatggtatatttgtactgaacgtgaccgactccggaagctatttctgctgtcaagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacttgacgaaattgacaggtgaaaaaactgacacatgttactgaacctgaaccggatttgattagatcagatccggagcccattgattatgcatccttaaggcggtctggtagagtaccacatcaaccggacagatactatggttttttggtccgggatggtgatcctgtcgaacttgatgaaaatgatgaggatccgatcacctacatggatgcaatgcagagacctgactctgagaaatggctagaggccatgaaattcgaaatggagtccatgaaggtcaacgatgtgtggacattggttgactcacccgaagtaatgaaacccatagggtgtaagtggatcttcaagaggaagaggggcgcagacggaaaggtggagacctataaagcccgtctggttgtcaagggatatcgtcaacgttatggtatagactgtgacgagacattttctcctgtggcaatgctcaaattcattcggattatgcttgcgatatctgcccatctggactatgaaatctggcagatggatgtgaagacagctttcctaaacggagaactggacgaagaggtgtatatgatacaacttgaagagttcacatccacagataagtctaaggtatgcaagctacaaaggtccatttatggacttaagcaagcatctcggagttggaacatacgttttgataggacgatcaaaacatatggcttcattaagaacggagaagagccctgcatttataagtgggctaatggtccaatagtagtatttcttgtattgtatgtggatgacattctcttaatcgagaatgatgtccctgcattacagggaataaagatttggctgtcgtcacagttctccatgaaggatctgggagaagcttcctacatcctagggatgaggatctatagggatagatccaaaaggttgcttggcttatcccagtccatgtacattaatactatgctgaaaaggttcagcatggagaattccaagaaaggctatctaccgataggccatggaatttttctctcgaaaaaggatgtccgacaacacctcaagagagagagcgtatgggtaggattccatatgcttcgacagtgggatctatcatgtacgtcatgacatgtacacgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaccaaattgttagaaatgaagaaattataattgagactcctgaaacagtccaagtgcaagaaaataatgagatttcaattagctatatattaaaagatgaaatatgggatcgaaagcaaattgttgttgataatgtatttgcttattcaatagcatctaatattgcttgtgatgatcatgagccaaaaagcattaacgaatgccaacaacaggatgattagataaaatagaaagaagcaattcaagtagaactaaattctctccacaaatgtaaagtatttagatttgtagttcaaactccaaaggatgttaagccagttggctataaatggatgttcacaagaaagaaaaatgaattaaatgaaatcgtgagatataaaatacgattagttacacaaggcttcttgcatagatctagaattgaatttgatgagacatatgctcctatgatgaatgccataatttttagatttttcataagtttagcagcaaaagaaagacttgatatgtgctttatggatgtagtcacggcttacttgtatggatcgttagattgtgatgtgtacatgaaatccttgaagaatttaaaatatctgaagtaaaatatttaaattcttataactaggagtggcaatcgagtcggatcggatcattaatgggtcggatcaatacagatcggatcaaaaaattatcaacctaaatccgacctgtttattaaatggatcaaaaattcaaatctgaatctgacctatttattaaatagataatctgatccgatccatttaatctatttattaaatagattaaattaggttaaatgggttaaacatgttaaacggattaaataagttaaacaggtcagattaaatagatcaaaaataggttaaacagattttaaacaggttaaacagattttaaacaggttaaacagatcttaaatgggttaaacaggttaaacaaattggtttaaatagatcagaaatagattaaataagttaaacaggttaaataaattatctaactcaatccgatctaaatattaaatgggttaaatgggttaaacggattaaatggatcagatatctaaaattcaaattcgatctaattattaaatagattaaatggatcgatccatttatgacccaaatctgtttagcctaaacctaaacctgtttatggcagatcgattatgggttggattgatgggtcggatcatattttttcagtcctacttgcaatatatactcagtcaaattacaacgatctttgtacggattgaaataatctggtagaatatagtacaatagactcagtaaatatttattaaaaatgagatattctaatgattcaatatgtccatgtgttttcattaaaaaatttaatactgagtttgttatcattgctgtgtacgtagatgatttaaatatcatcggaactcttgaagaagttcgaaaggctgtaacttatttgaaagaagaatttaaaatgatagaattaaataagataaaatattgtcttggccttcaaatagaatatatatcaagtaaaattttcatacatcaatcagcatatactgaaaaggttctaaagtgcttttacatgaataaagttcacccacttagtttctctatggttgtgagatcacttgatttgaaaaataatccttttcgatctaaaaaagaggaagaagaatttttggatcctgaagtaccgtatctaagtgcaattggagtacttatgtatcttactaattatatccaacctgatattgcctttgcagtaaatttattagcaagatttagttctgctcctactcagagacattggaatggcattaagcatattatgcactatttacaaggtactgttgatatggatttattttactcatataattctgagtgtcaattattaggctatactcatgctgattatttatcagatcctcataacggtaagtcatagattggatatgtttttacttatgctgactgtgccatctcatgaaaatttgtaaaacagacaatggttgcaacttcatctaaccattcaaaaattcttgcactccatgagacaagttatgaatgtgtttggttaagaatcataattcaatatatttgaaaatcatgtagattatcttctataagaaataccacgtcggtaatatatgaagataatgctgcatgtattgcacaagttaaaagaagatttatcaaaggagattgaactaaacatattttactaaagttcttctatacttatgagcttcagaaaaagggtgatattcatgtgcaacaaattcactcttgtaaaaaattagctgacttattcactaaggcactcccaattatgatttttaagaaattaatttataaaattgggatgtgatggcttaaagacttaagttgattatagagctagtttttaggagtactgtactcttttttttttcaccttggttttgtcccattagatttttcaggtaaggttttaacgaggcagtatgtcctaaataattcacaagaatattgtacttttttttcttgactaaatttttttttcatagaattttttttaataagatttttatgaagtacattcttcgtgaatggatcttccaagggggagtgatataaatagtcgttgaagctcatatggataaccctttcgaaattggaatatattataaatagtcgttgaagctcatatggatgagtctttagaaattggaatgagaaatattatccttcagatgagaaatattatttcctatgtaaatgaataaaaaatattattttcttttgtaaatgaacgagaaatattatttttctttgtaatttgaattaaaaatcaataaaagggcttggaatgaaatgagaaggattattaccgtatgaaaagatttcctctctctctcgttctcttattgtgtctctctccttttattatatattttattattctacaatatatttgaatatttaaatgtgtgttcaagcatgtataccacttccaagatccatactttaaaccaataaagtgctcaaagcatataagtaaaattttttatcaccaaaagcatgcctaataagtttttaactaatttaatttaatcagcaatcatagagagataacaaaagtccttgtataattgatagtttcctcgatagggatgtgtatatatggataaccatgaaagtgatcgaaaaaaattgagattataccactctagaaagataataaaaagtttttctaatcattactaaaaattatgattaccatgaaaaaaatataattcccattatggcaaattttaacccaaaaaattaattttagtaaaaaaaactttaccttttttagacatcttaacaataaggttgaaatcaaatcggatacggattagatactagcatatttatatctatatttattttatttgacgaatataaatatggatatggatattattcagatgcaaaatttatatctatatttattttaaataaaaatatatataatttaaaaataaaaaatatggatataattatgggtattatttagacaattaaactttatagctataggattaaagatattactaaatagatgataaattaagttaataatatatttatattataatatattttttaaaaattaataaatactatataaaattatataaaattatatataaatttaaatattcggatgtagatcatgtagttgtctatccatatctatatctattttttttaaaaaatataaatataaattattaaatttatatttatatttaaattaatttaaataaaaaaataaattcagatggattacatcaatttccctttcatccctactaatcatcttagcctttaattatatcacgtgattaaaagaaccaaaaggaatcaaatagagaaaggaaggccagcctccaaccaatgtcctctcatcaatttgacatctttccatcaagagcactgaatacgccgttcaccacctaaaacgtcacctcaaatggacggctgacagatcatcaacgtctctttctagaagggttcgggttgtatctttcgcgtggagggacgattcaccttcttcagcgacatcaaccgttggatggcgcaacagagttgaaacaggttgtttgaactgctttaagctctgtgcgaaacgcaatccaacggtcgacgtcgcgaaagaaggtgaatcgttcttccgcgcgaaagacacaacccgaagctcctttcatttgaggcccggaccgacggccggattccgcagcttaaaaacccaagcgtttcggaagaaggctccgtggatgatttttatttatttttttctctccagaagaactgtagttatatattgtggaggaaagagtggccgaagccctctttcgggtgtttgggtctcgctcccttcttctacccttcgtctctgggcgtaggccaggtgaggcgaagacgaagaagaagagggggagccctcgccgtgtggagctcagctagttgatttcccaatcttttttttttttttttggctggcttcggaaattatcgaattctgcttttatttctcggcgatttcttggtttcgatcgatcgtaggccatggatgagagaatcctgctgggtagttacttccagtactccccttctggagtcccctcgtctccccaccattctatgaggtctcctgcgtcttctgatagagaaaggtccgttccattgcgttttcattctattcttggttttcttgatgtgggtattggagttcttgattagggtttgatagggcatgtgtttttgctgcgtaactctagtgaacgattggtggttttattgggcgggtttgatttctttcctcatgtttgcagaagttgccgttgtttaggttgatctcggaattttgccctttttgttggggtttgattgagtgtataagctgttgaaattttttggggcttagggtttttggtgattagttgttggcttttttgtatgctaattttagggtgccttgaatttatttgcttctgtgtcagttgtttggtgtgtgtgggtgctggcttgcatgtgtatattgacataaataatgtttgtttttatctagtctcatgtgctgaagtctatcaagcaaacaatagactcattcttttacccaaaaaaaagaatagattgattcataatttcatggtgtatctgcctatgtgtgcatgcatttatgattttgtgtgaatacacgcacttaataatgtgagttctaatgtacttctgagtatgcatcataatagtccgcgtagaggatgtgttatcaggtcattctgttcaactgctaccatcttagacattattatttctgatatcaatgaatatttttgaatgtttgaactgttaatgtgtggcctgcatctataattttgtatcagtatgtgttagtgagcaccgctgaacgtcccatggcttttgtattccctctctctctcaatgaatgtcctccactattaaagtacatacatgaacatccaggtttgcaatcacagattagcaaaaattatttttttagtttgtcgaatcctggaaatatgcccctgtttgagtgctatgttgtctgctctgttatcagtactgtgctggtccatttgctgttaggccttgttaagttccactcatctcgagttatttggtctgatgctaacagatatttaactgaactgctggctgagagacagaaattggtagcgtttgctcaagtactgccattttgcagcaggcttttagatcaaggtatgcagttcctttgcttctgcctgttacacgaagtccactagcttaattggtcattatattggctagtggtttcctatgttgttatttggtgaaatggtgggtcaacattgttgcattatgggtcatacttgtcgttattgtgggattccccctttgcttctgcctattactgtgttatatgaagtccactagcttcattgaactttatattggaacatcctttgttcttatttggtgaaatggtgagtcaacattgttgcattgagtatcagtcacacttgtcattattgtgggattctcactaaaatagtatttgtagactttttgtttaaaagtctttgagtttttactgccttgcttatcccatcagtcagataaaacctggtttttggaaaattgcatgtaatatgattttactttgattacttcttcttcgtctacttcatatcatatgccaataaaatattcaactttggatgcaaaaaagattcttattgtctttcatggtttacttggtgatgctctgacatgactttgtttctttttatttattgacatataaacttcaacacagaaattattcgggcatctggtttggcacctaatcaaagatttgttgatcctgagagaattgaacatggcaatccattaagactgactcgccatccttcaaatggtggaccaatggatttggagggctggtcaggaatgcaaacagaggtaaggtactttcactggttacccttgttttggtaattgattttcttcagcaattaaattgacagatatatgttgccttttcgctcttgcttttctctctaaaagagaatctatgttttctatgctgttctatatgttagaaactttagatttttttgtttttaaattaatgtaaaaggttttgtttccattaactttgcttcatcaatattgcttgcagcgaaggcttctgtttgttcaatgaagttttgttattctaaaatttattcattctatctgcccaattacctgatactggtagctatttgtagttgtattgttgctgtatatgctactactgaatatgtggtttcaagaatggtaactgattaagctaattatttgggatgttaggatgtaagacaggcctcaaaggaatgggatctggtatggtttaggattaagctaaaccctacgtattgctggaaacttatgttgaaaactgaactgcactaatgtgagttggatcctaacacaaaattgataatggaggtggttgtggaccaaaagatacgaaacatggtctggttggcactttaagacttaaccctggtgggaatagaggaattttactgcaatttgttacggcaatgaaaacttggggtcaaaatttaaatgggaatctaagttgaactatcttactggggaatgatgaatagcaaagtatttatactggactgaggttggtacagaagtttaaaggagtttatgaaggcttatgctgtcaaacttgtagactatgaatagtataaaaaataacttgaatagaagaaaatactaggacaaaggaaatatagtagatacctatgtttgaaaaatcttaatatagatataacctgaaatggggatgcttggcaaatgaggatccattaagcaaactccagatagctgagacaaggctctatgattatggttatgtaaataaaatttatactagtggcctcatgtcatcatgagctgggggcttcacccctaggttttgaagatctcacaccatgaaacatgtagacactcttcaattgtcaattctccattaactaagcaactggtaatagaagactttgccctattctaaacttgtaaagctggtgtaaagaaaatgacaaagaaagaaaatgaaaagtgaagctattgtagtccccgcattttctaggtgatgagggagaccagctggatccatagtgtgtctggccctctttaactctttactttccttcgcatgaacaactaattcttaagagaggcttacagaggaaattaatacataaatagagagtgaacatggtatgacttcttatttgacaatctaaaatttaaaagcaagggcttcatactgatatgtctccccttccagtatttttgacatctacatctatactatttcaagcaaaaggagaaatttgattttttagagtctttgaccagattcctttggtttttcttcccaaaatatgcttgaccaaaaaagaaaatccctttaaaaattcccaatttttctcaagtctcctctccttaaccagaattagaaaataaaaatgatgcagtgcctaaatacagatgcctaatcaagacccgttaatatctcatcttgccatgaatatagatgtatatccttatgctaaacaaattgggttagcatcttagtatagatatagacacctttcgtatattatgatcaatttcccatcttaaacatggatgattctcctctgttattcttaaatcgggattacaatgatccattaaggtgaaaaaaagtatgctccttttttctatatagatgttcttcttgatttcttccataggtaatgaaagctgcaaagtaaaatgcttttcaacggaaaggagtacatttaacaattcacatacgaaaataattaattgaataaggcctttctaggccttacgcattcttctttgttggcactgcatgctggccagcatgggaccacaactgtgctaatacagcacatgggagcctgacgcatgtgccaattgcgtacatgtcattggttcgggggtgtgcgaggtgacacccacaggcaatagaggatctgcactcactaatgcagcaatgcttgacagattcagtccatttctcattttgcttttatctttaaatatttttgtttattatctgttttaatttatattttaaaattcaattcatctaacagtatttttgtttttatgctatttttttattttgatattccatactgtataatttaattctttcctctgatgtacgctgcatgtgctaatttgttaatccttcccagaataagacttccacttcgtggctatctcctactaagtcattccttctaccttatttttcatgtataaatgcataatcacaagatattcttccctactcatcctcatttgactgtctatttgcttaccagcactggatttggagcccataaaagtgcacatccatcctctctctctctctctctctctctctctctctctaattttaagatccttttggaaggaaaccatggatgggtggttcctcaaaagcaagctttgtatggctggatttttcaataagaactctcaagagactcattcttattactgatcatattggtttattagccaacaagaagatgcaagattgcaatgctaacctcaaagtgaattacaagtgttgaagggaccaatttggtacaaaatgttaacaaaataattcattagttccaacgagcactagagaattcagttcagtccgggtgcaaaccagcctaaatttccccaattttaaaacatctccatctcccatccatggatgtgggacttatatttcagcaccagataatttgtttagcatgcaatgcattgtcaggaacaaaatatggaaaagaatattaaaagatcatagaatcaggacctttctgtagcattgttgctgaaagtgatcgcatataagataataatgagaaataagtggatagggaagtcctcttgtttcatgaccatcaatgacatgaaaagaagagtgttatgttttgggtagcagctgtaacttgaactgcctgactttttactcagccaggttatgttttcaccaccttctccaaaccttgaactaagaccttttctggaaattaacagaatcagggaagagctattgcaaagggtgggttggacagcagtcacagcatgcatgcttcccttagagtggtggcaccctctttcttttcaggatcgctctcttgctacccagtcaattgcataatttagaatatttgcctgatggtacaaatcttagcactgaaaagttgattattccccctgaaggagttcactcattaaagcctccttggacctaaggatgcaatcacaattaaagttgtttttatgatcaatatgaacaatgcaagaaactacatgaaagcttcaaacataattaaagttgctatgcatgtgtgcatgggacagcaaaagaacatttctgaagattttgggactgagaaaaccttaaataaaaggctaaacccttcactgggattctagcctttaactggctataggagttggatctgacatgatttgaaggccatattgtcaggcaaaaactccgtttttaagtctttcatttatctagtcaatgcaagaagtgtatggttactttaggaattagaggacttctatatgtgatttgctatttttgggtccctttcttctttctttcagttgttgactagtagagacccttggacatcccagaataaaggtgtcagtaaaagtgagagctttcctatagagttttaagtagagcaaattatagagaaaatacatgggcagtttgcttctaaaagaagtcatgccaaggcttcaagtaagttgtatggctgatcattaaggatgatttatgcactgattatattttgagagcaagaaaaaagaacttcacgtcaggtttggtccttgctttttcttaactatctttgcaattcttttgcatttcttaatctacattcttactctttcaacctgctatcatatttgctgtacaagaatttatttgccatgcttgtcttactctttcaaaaaaatcaatcttatttgtgggaatttgattccttgataatcttagtgcttaataattaattttggatcttaagtttctttgatattttgttctttctcctcttttcaccaataatttatttccatggatttttacatggttcaagatggaacctattccttaaattctagagcctttataatgtcatttctagtattattcccattatctaagctctaggcaggttagtttgattatccattttgttgcaacatccaaaaattcatatatctggaagctagatagacaaaaaaatcccaaaaccatattaaatctaattctttggacctttaatgcatacacggacctgacattgttcctgtgcctagccagatagtttgcaatcttcatcaagttctcgccataaaacctctgtttgggatggaaccagcccaagtggccacttagctaaatgccctcatgaatttcaccatctcctatcaagtgtttcagagaattccagaagcccaagcctaaatccggaatttagctgagttcctcaaagaaaacctctaaccgaacccaagagaaggtagcatcaaagaacatggcaatggcaaagaatctgatctaaatatagcagttactgtaagccactatcctcaagctgatgattgcataatctctggcaactgcagggcatatagacatcataattatggtgttagggactgtcaacatccatcagcagggatatggagtgacttcaacttgtttcctttttctttttcctgttctttctgtttttttaagcaatgagtttaataacccaaaaaaaaaaagctaaagcaaaaggctgatcaaaattgggacctggtatgagtacaatgaagcaagggaatgaatgataattaagaatccaaagttctgttttgtaattctaggttccaaagttaagcctttcttagctaaggaagagttggtggtgtctttgtttcgatggcccgaggattgaaacttgtcaacgcttaccttagttttctcaatctctctctccttcattcttccttgtctttgtcactcaaagtattcaatactatgtaattttgagtcctgatcttatgtatcatttgaacatcaggtatgaatttacaagccccatgcatgtggtaaagatgtttaaagatgagttataccagcttgtcttcttgatgccatatgcatcttctaatcaattggtcaaaggtgctgatccatttctttcttatttttacccttcctatttttatatggggacgcgtgccttcatgttgaagagggtgaaggagagcaggggggagggtgggaaataatggttttaatgccgatcatttgatgtcttctgcatagccaaaattttgcaccagcagctgcttagataatgcattgtttgacacatgcctaaatgtacagcttgaaacatccccaatgttgaattctggtgctgttaaatgaagacatttttttcttaaatgtccattgtcagcttatttttcccacttggttattgaaaaatacataatactgacctgcctatagctagaagttgattttcatcattctgtgctgatcatgtctaagttgttttatgctaaccctgttcaggacaatgggcattttcaaagaatgggaccccttcaagcatcacctgttggttggaatggagcttctggtgttgctaccagcccaatagttaaaaaagtcattagattagatgttcctattgacaaatttcctaatgtatgttaatcttatctggcttgtgagttgagttcttttgcatttaaatgtcaattaatatatttgcatttttgtgaagcagtacaattttgttggccgtctgctgggaccacgaggaaactccttgaaaagagttgaaaattcaactcattgtagggtttacatacgtgggcggggttcagtaaaagactctgcaaaggtactgtgatgactattatcttatatgtccttaaattttgcctcaactcttcttgagcatcccttagcttgtggaatcattatagtttatgaagttttgactgttgtatgacagtaagttaacatgatttctatggtctgacctaattctacaacaaagtgatgcttttgttgctatttacaggatcgtagtgtaccgactgcctgaacatagagggtacaacatttgtaggcacatatgcaatttatgaattttttagggtattcacttttctttaaaggattgtttagatcaaaagactagaacttgctgttttttaaagtatctgatacttccccaaaattggtcaattcttttttgcaaaataatcagccacttgtctcagtcatgaaatctgtggtaaaaatacctatttgaagcagtgctttcagtatttctcctatttgcatagattaatggcatgcctttctttaagctaaggttttacatttctatatattacctcataatgatttagtttccttgttgtttgattttgtaagttaataaaatgctatactttatatatcagctgaatcattcttgtgatgattgaaattttagtgctacttgctgatcatcagattcttgacttcatgtgaaagaagaaatcaaaggcagggataactgttattttactatgagagggcaatgtaacatccaaaaatatggactgtcatcattacaatcatttactggctaagataatctgatgcatgtaaaatcatttaatatcattataaacaaaccacatagacatatacagtattgattactcagaaatatgatcaaaaccaaatgttgtatttgtggggttagattaaagtataaacccttttttcaagttaaaaaaaaaaaaaaaaaaaaacaaaaaccaatgttgactacccatgtatacttgaagaaatgaagaaatattccaaaagaacacgggaaagccaaataatccatgtttatgggatcttcaatgcaatcaatttcagctgaaacgggctgaaatgactgagacaggacttaagctagtcaattttactgaaattgactggaattactgaaataatcaaagcttaaaaccttggattaaattctccatcaattagttaatagtcatattttattaacacaggtgccttgagctttcccctcaggtttagagatccggttgacccatttggtcaatctgtcacctattagatattgcaggtcagatcaaggtaaaagctggagtgagattttgaaccattaacctgggtggttcaactacttgaaccacctacaccaaataaaacaaacttgagtgctgactgatgaggaagaaaaggggaaacccctaccccccccctaccaaaaaaaaaaaagatttttcatctcttcttagttataactcaaggttttaaatctcatgggtcagaggtgtcccaatatgtctatggaataggacaccccaccatcccatcccaacaatcatctagtcatgcatcttggtagatatcctccgtgtctctccccttctttccttcctttctttttcttttttcttctaccttattttcttttcattccttttttcctttttcttgtccttccgttctttcttttttccttttcttcttctttctctttcctttcttccttcttttcttccattcttttcttatcccttcatttcttttttttatttttcttctttttcttctttttcttttctttcacttttttctttcttcatctttctttctttccttcctctttctttttttctccccgcatgtatggatttcggagtctcgacctcatcccaatctcattttctcacaagaataggtttgcatgcctcctatctagttgggatataaaaccttgccataaatttgcctagcccttttcttggccatcactcttaggggtagcaattgggtcaggttgggttagagccgggtctgatcaaaaaagtccaaacctaaatctgaccaatttattaaataggtcagattttgaaatctgaacatgtcttgtttaatatataggaaacccgatgatccgatctatttaacctatttaaaaattaggtaacccttttacccaatctgacccagctgtttaacttctagttatcggatctaaaccctatctttaattcttacaattagatgaattcaatgaagggaatgaaactaaccagagaatcagggaatcaaagggcagctgcagctagacactaatcgagggcaacagcactatcgtcccacattctcaggcactcccagtggagatcgatgtgggggagggagcagaagagggggaggcgggggtagggctcgacagtgatcgagaagagatgataggtggtgccatctcgaatgatggtcgcaaggatgccgttcatattggcatggacgaagaggaggaagttgccatactggcataggtcgacaagcatgaggctggtgatggcctattggtgccactcgcggagcttcgtccactccatctccttctggctagtgatctaaggagactagagaagggaggggaggaagagagggccgaaccatggaggagaggaggtgaggggagaatggggagggaggagtctactggctttttttttggcccattgaaagagagagagagagaagggattatgtgggtcaatgggtgtggttgcaacgcgcagcacacgtatttttttattttagaagacaggggtcatatggatgtgaccacagagcacagcgtgcatatttttctgtttgcaagacatgctcatgtcaattcaaattttaaatagacgaacaacggacttagacagtgttagactttatcatttattttaaatgagacgggcattaagtggatacccaatccgactcgacctgtttaataaatgggttaaatatgtcagaaggtcagaacttgaacccgacctgtataatcaaataggttaaacggatcgacctatttatgacctgaatccgcctaagccaaacccaaacctgtttaaggcgggtcaaatatgggttaggttgatgggtctggtcatattttttcaaccctaatcgctgttgttatggtcaatgcagggagaaaccttgctgttgaagtgatttttttttttcctttggggggaggggctatggtggtggtgaacggtaagggtgcttgagcaatcaatccaagaaaaggggaagatgtcttgtcaagcactggctatggggccagcttaggggggatcaaaaggtgagaggaagatggctacagctagagaagggttggagatcaacacattggagaggtctagagcttggagacattggagaaggagagaatgtgaatagacacagtaaacaatgaagaagcagggatatgagaaccatacaaggacttgagggatttatctttggcctggtcagactcacagtcaacctgcagttgaaccatgagctggtcactcggccaacaatgtggtttgaactaggtcaatggtacaagacactgcttcctcttgattctccttgttcctccaattttttcattatcattccaccttgttccattgaaggattttaaaaaaaatcaagaagcctctaacgtgaatttgagcccaaaaacccatagatgtggcaaacaattcctatatatattttttttggtgagaacaaatgtttatttatttttagtacgttgagttactttataaggaaagttaaatattaaactgcaaaacaagagaagttttcaaagtggatatgtcaacatagagtagacaatcatgcattattttatgaacagatgaatatgtcatgggttttacgtctgcttttcagtcgagacattttggagttgcagaaccttattagttagaagatgagctccattctgccatgattacctactaaaggccattcccttgtcatatcaaatatgtctaacatctctctcatccactgcttaaagcccaaaaccatcatcacggcacaaagtacaaaccattaaaatcagctttacattatttcactatattctctacctgcattctttatcagctacattcattgtatactctttttgccaaattttttctgtcatctatttgaatttctatgcttttcctatcttatgtaagtgctattttcaagatttccatttgaattggttaattatacagagcattccacatgactataaattgttcctgagtgtttttggatccgatgattatgtattcatacttcattatgactttttcattgtcctgtatcataaaagtttgaatacaaaagaaataactgttcagggttgtcattatgctgcatgactagtcatagttgatttttttggtcattatgctacatgtctcctgcaaattggtttattgctcactggttatattaagatatattacttagtgctaagaaatattagcacacagtactgccatttgtttgccatgttcagaggctccggtttcaaatctttctcaaagatagatgattgtgggtcttgagaggacctatttgattcttaattatgatcgttggaatgaagaggctttgaggaccttccttctaaggagaaagcacgaattttcttgtccatttccatgatagaaatgtctccctttgaaacttcctctcctctcacccggaagcttgtagatgcactttttcagtcacatggtccatgtgttgcagttgtatatcacttgttacaaagtgggtcgcggttctaagtctaggccattgtacttttagtcttttactaacacactgcttttgcttttttcatgctccaagtattgacaaactcgatcagtgacaatcaaggtgcttacaattataggcatcttatgctgttcttgaggtcagtgacaattgaggaaagctttgaccaaaatggattagtttctacccgaaatgatcctaaattggcagatttttttgtaagcacttaaactgattatgtgctagtattcttcataatatagatatttaatatcattttaagaccaccatttcgtacattttaaacttggtgtgattttaggtaattttccaattttcttaaataaatctgattagatagtgtcaattttagtatatttatggatgatagacctaacatatgagaaacaagtacttcattaacattaaccatatatctttggaatgtttaaaaaaagatttgggatttttggcaccaaaatgatcaagaaataggcagcttttctttgctttaacaaaatcattcaggtcttgaagatatatatatatttttttttctgaagaaaaatatgaggaaaaggttctatgcataatatttaagtttagtgtgctaatgataggaaattaaggtttattttccatgccttgaatctgttaagtaagctttgtagtgctttgtaatctctttgttgttagccaaggagcagcttggggttgtttttgctaggttttactcaataaattggattggcctctgcccaattcttttctcaaaaaaagaaaaaaaagggttttctagttcttagcttaaattcttaagacatttagttgagatatgtcaaattatagccttttcggaattcttagtagattataagtcttatgttggtatttgttactcaagatgatgttagttattatatgaagttccatgttgatatgaagttgtatgttcttgtcatggcctaattgaggtcctggagtccttgttgatgaaaaaattttaggtccagtagtcatcaccaagaatgtatggactttggagtatggtgttttttgttatctcctatctaagtctttgaaaactataatattagatagggttcattccatggttttatgtcctaacgggacgagagcatcccggccgtctcggtcgtcgcatcccgtttctatgagaaaataaaattgggatgggcttaggactccgaaacatatccatatagggagagaagaagaaagaagaaagaagaaagagggaaaggaaggaaagatgaataaaagagaaaaatgaaaagaaaaattaaaaaaacaggacagaagaagaaaaagaaagaagaaggaaaggaaataaaggaagatagaggagaagaaagaaaagaatgaagaaagaaaaaaaaggataaaaagagagaaaggatagaagaaggggagaaagatggaggatatccatgagatgcatggctgggattgttgtcgggacgaaatgggacagctgagcctctcgttccatggagaaatcgaaatacctttgttccgggggattaaaaactttggttcattccttccatatcaggacttataatttctgatttaattaatgatgaagcctaattcctttgtttttttcattatgtgctgtgctgagcagttaaagagaactgctctgatatgtgggcttgtctacctgtgggctgtattggatgggctacttttctatactgttctttccttggattcatatgagatgcattaatgttatcagtggtgttttatgatagtgcactctatgtcaaccttgaacagttggagcaggactcatgcaaacttaggaacagcgttgacattatgtaattaaacttagcaattatgcatttgctgttctttatgctaaaatctattatttttatttacaaaactatcaatttggggcagaatctcgactgcttatttctatctcgacctgcaatttcatttttctataggaagaaaaactaagagataagcctggatacgaacacttaaatgagccattacatgtgcttgtggaggctgagtttccagcggacataattaatgcacgattaaaccaagcggtggcaatacttgaagatcttttgaagccagtggtacatatcaatgcacctctctctctctctctctctctctctcactcatgctaggttacttattgtggttcttgtttctaggatgaatnnnnnnnnnnnnnnnnnnnnnnnnnnnnnnnnnnnnnnnnnnnnnnnnnnnnnnnnnnnnnnnnnntcgacctcctctctctctctctctctctctctcactcatgctaggttacttattgtggtcttgtttcaggatgaatctatggactactacaagaagcaacagttaagagaattggccatactgaatggtactttaagagatgagagccctcatatgagccccagcgcatcccctttcaacagcacaggaatgaaacgggctaaaacaggacgttgattcaagaatcgggtggtggatatatttcaaacgtgacaactaaagttgggttccattaccttatgggtgatttaagattttggtggtggatacaattcaaacttaacaactaatgttgcgtttcattaccttctgagatgatgctattttcagatactcatggcattcaaattcttcgcaatggaatcatcggaagggccctggacaccttaatatgttttctcgtggtagatagatcaagtgcttatattctttgatatagacatgtttgtgtggcagttccttaatgtttcattcgtgaacattgctataaagtttccataatattcgttctgtatttttttattgaatggtggcattaatgtgggattacctcattatgtgctcccatgatagaattttaaacaatataagtgtttttgttattattgatgttctgtatcctcacctatttaaatttatgacagatcaaattattatctaatatgcataatatgtgtataacttgccagtcgtttttgtagaaccttttgcagatccacgcagagccaatcatatcctacctatgcacgttcattttggttcgttttactgtgccttttaggggagcttatgatattaattgtagaaatttggctgcaggcatctatttctacaggtatatgactgcgtgttaatctaactttgttgtgccaaatcagctttagagatgttctttatttctgacaggaagtcttttttttcacttgtcttgtaatcctgtatgtattttagtaaacatagtgtgagtttgtacaaaaattattttaaattgctttgaagcttgattggcatgatgaatgtactgttattccctgcaactgcaagggctagagcttaataaaactagaacctcatatgaaataattgctcagttaatgtgagatttcttttatagtttcttttcccccaaaaaagtatagcttgagacagctgctgttgcagttctttgtcatctcaatcacttctcacgggagagctttatgaggagctgtagtttctggcatacgaagaactgtagatccttttggagtctgattttgtggacggctttgacatggctctttcctgtgcaagtcacggtggctcgatttgtcaaacaaatcttagatgtatgggggcttttgttgcaggtcaaaatcaagaagcttgccacagtcaagttcccaatgcgattattagggaaagaatttagctaatctcaacggattccccctctatggaatctgaggatggtaaacctacagaattaggatcaacaactaattatgcccttaggcagcacatggtacaagggagtaacgggaatccaatggaggttcttccaggctctcgagaggtgagaccccaaaccattcctctcctctcgtctctggagattctctctctccatcttttcttactgcatagtctttaattacaaatattttttaaattagtttttgattaaaaattctctattacctagtaagggtgtcaagtttgagggtatctgccgtcttgaaatatctctgaagaggaagaacctgtcaggtgacaatgggaggcacaccgaaggcttaaaatgcttcaaggctttccgtgtttatacggagactaaacaattggcacgctggattgtaggtctctagattgaaggagacatcatctgtgcttcaacattttaagaagctatgtaggtttttggttgagatagattttaaaaagatggcttagtgcacaaggttctgaccattgcagagtttggaatgaattattggtatgcaatcttaaccccgcatgcagagtgtttcaaacccatgatatagactaatcttacaattgcaccgatgctcaaccaaggcaaagataggttttcaaggatacatttacatgatacaagaaactatagcctttttgtctaataaaggggaaaagaacaaaaaagaaaaaaaaagaggcagaagagtcgtggttgtcgtgccaaagaccaagtccacgagtacttccatggtgtgtcattttccatggacctttttatttggacactgaccaaaataaatttaaaaaaaaaagattgcaaaagagactgctgtaccgtacatccgccttggccgtctctctcatccactgcttaaagcccaaaaccatcatcacggcacaaagtacaaaccattaaaatcagctttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatatatatatatatatatatatatatatatagagagagagagagagagagagagaatcaaatccttttcatccaacattaggccaattcaattgatgcttcacataagcaaatgatgatcgggacatggggtgcacattcatgttcagcataacagacatttgtgtttctgttgtcctttcttacaccgggaaacatgatgggatattttgaagaagttcttgttacataaagaatgacataatggaaaccgcaaagaaaacgaaaacgacaatgacaattgcttacaagaaaaattgatgtgctctatagtttaaaactcaagcctggtgcatctcttttatccaggtatttctggcgtattgtttagagccgtaacaagaaatcactggcactgccaagggaattaaaaacctctcgtaattcctgatctcttgcatgtcctgtatacatgtggcaacatcttaggcatataattataggcatattttgaaacaaaataccccgttgcttttttcttatttaataaggaaaaaaatgggagtaaaccatccttattcatcccaaagagaaatgaaaagaacaaggtattagaaaaaaaggcggacttcccaaacgagaggcttcgtcaagaatagatcagcggtctgaccaatcctagaaagatattgtcactcaagtaatgtttggcttgttgttgttgcggccaattccctcgttgcctgatcatcgggaaataagcgcctgtaaaagaagtccacactgaccggagatacctccggcagggatcctccgacggtcaagtcagagaggagactaggcaacagtagaaaaaaatcaggagagctcagcgatagagagagagagagaactagagagggagagtttaggggcttcgaaagaacctcctccggcactgttgccttccccgttttatagtagagcacagcatggcgccgtcattaatggcgcagacaatggagagttgtcaaatcgtcggagactgtcagagccgtcgtgggactgtcaaatcatcgtggggctgtcaaatcactagggttgacccatgtctagggtagaacgatgtctcagggcggctatgccgcacgcctctgtcaggacgggcggccttcagcagtcgtacggaatctggaggagccgaccgaccatacgtcggtatttggtcgtaggatgtcgggtaggtacaccgtcggctggcgcggcgcatcgcggggatcggacatcggccaccacctccgatggtcagtctgatacgttgccaaggttgggggtcggaccgtgtcgttcggccagtcgggaacgggaagggtcttcccgaccgacataccttcggtcgaacggtgtcggtcggtgtggtcggtagagtcaggtgttggttaggcgggtttgatggtgagtcggtgcgagagcgaccggtcggtatatcccaacagttgcccctccactcctgagtcggatggcgtgatggcccgcgcccttgcatgggcggcggcgtcgggcgaaagaagttgatatccattgcattatgttccgactctagcgaccgtaccaacattcggtccggtgtcagacatcttatcggtatcaggcgactcatcggtgtcaaacgtcccatcggtgtcaggcatcctatcgggaatagaaaccaccattttcgccgtctcttcgggaacgcaaaccgccacgacttttccgccgcgtggcgggggggccattggaccgaacccgctcaggcggattgagtcgacgtggccgaatctggggcaggtgcgtcgaaccgtcgagccgaaggaaggcccagatgccgccacgtgtcacgatctgggagatcctcactggtcgtgctttcatctcgaccgtcagggggcactatatatacggggtcacctgtatccggatttttacttttcaaactttctgtcgagaccctggttgagcggtcccccttgtctcaggtaatcgtccccgtttcctcccttagaaagtctttttccctaggagccttcatcgttgtcctttgttttctccttgtttccttgtaatcttctttcttcttcctctcattccttgactttggttctagcgtaatggctagaacatctccacggggaggtcgatcggggaacccgactgacgattcccgatcgaccccggaggtgaaggtcttttcactttcggggccgaatgttgatcggctccgggagcagtactgcatcccggagcagtttcagctattcgcccctggagccgatggtcgggttaacaacccgcctgcgggccaggtggccttctacatcgaggaccttcgggtcggtcttcgcttttcggtttcggagtttgtccggaacgtgctggattactacgagctgtgtccgatgcaacttgcaccgaattcggtccgactagtagttagatttgccctgttgtgtcggcttttgctgaccaatcctcgcctttcactcttccgagttttctttgttctccgaccccaccctaaagcccgagggtggtggtatttcaaccctcggaagggtctctcctttatcactggtcttccatcgtcgattcatggatggaagaaccagttcttctttgtctcttcttccgttccttaggagttcccttcctgttggggagacccccgaacccaaccaaacgagaacagtcgggtggaggccggggaccgaaaagacttccaccgtctgaaggacatctcggtgccgaagcagaaggagctcatcaccgaacaggccctgtatgacgttggtcttagctcggttcctcgcctaggtctggcttttttttttgatgctgatcctctattgtcgttgcagatatgccaccacggacgaggttaacggcagtcaatattcaacagcatgcggcacgaaagaggccggtgcatggagccgaaccatcacggcctcccaagaggccccaagtagcaccgacggtgggagcggagtttgtttccgaatgggcgtcggaccgagagccgatcatcgcactgtcggtgccgacagtgcccactgaagtcccgtccgaggaaccatcgatcgagggagcagcctcgcccgagggatgggcggccgaggaatcgatcgaggatgtgccgaccgctcagccggcagaggaggttcgggaagaggcgcgcgagcctgaacaacctgcgtcggcggctgccgcaccttcgggagggacccagtcaggctcgagcatgccctccctttccgacgtcagggcctgggtgtccgcacgagggaaggccccgatggcacccgatgacgataggaggtcggtcggtggcggagcgtcgaccgattacccgtttcccgaaggggcgtcagccctggccctccttttacccgaccatgattcgagtaagtctcttccctttacttttcgttctcatcgttgcctttcataagttcgatcttctgacggtcggctttgttgtccatagctgatttacaatatgtctgaattggaggtcgggtatcgaagattcgacgatctccgggcagcctggaaagacaaggccatagccgccgaagccgacaaggcggtgttggtcgaccagctgcagcagtcggtcgattgggaggcccggcttgagggggagatctcccgcctctccgtggaggtctcccaactcaccggtgctctggctgcttcggggatcgagctgcagtcgacccgagatgacgccaagtggaagtctcgcactgttcgtcggctgcgatgcgagcgggatgacttcgccaaggaactcaaggccgaacgcgatcagctccgaacgagtttagaaaatctcgtcaaggccgaagagaacctatccaccgctcaagctgacgcagacatagcaagggcggaggcggagtcggcgaaagaagccatgggtcgggccgtggaggacttccgtgactctgaggaataccgggaagaacttctagagagcggcttcttctcgtaccgtgtggggtacgaggacgctcggaaagccgtctgcagcctgtatccggagctcgacctcggtagcatcatcccgccaaagtcggaggcccaagctgagggagagatggctgacccatcatcgggagatcgcaccatcgtggtggagaccgacgcagaccaggctgccgaaggccaggcggctccgacccctgaagcggctccgacccctgaagccaccccgacccgagcggatgcgtcgatcgcccccgatcttctcccgatggaagaagccgactccgatgattagtcggagttttatttttgtttgacgtacttgtagtcgggcttcgacccattttgtaatctcaatttgtaatcgggcttcgacccattttgtaatctcaatttcaagtctgaatgaaattgaaaacatattttcttaactttctctcttacttgaattgctttgtgtgtttgggatgtatgtttcaccgaaacacctttgaacgtataagtcgtaggcccgacgcactaggtaggatcccagatagctagccggggtagtcggtagtgcacgcgccacttgaaggtagagcaaaccctaattttcgatcggcttcccgactgtcgtataacccaatggtcgagagttcaattcgagcgcccgttgcccaggcctgagtcgggcatattcgtcgagtcgggcgtagctctttgagccgatcgtgttgtagggcccgatagttaaacaatgactgacgcgtttagtagatgacaagtcggtcatctgttgcctgattctctgtcaggcgtatgcatcgagatgtgtggtaaatggtggtaagccgaatacccttcgaccggccgtgacctggtcggtgggttgcgaacgcgacattagtcacgttggccttttgcctttcttggccggagccaagctggcaagttagccagtcgccttgctcgggtgctggctgaggaaggggtgcggcttagacttaggggagactccatcgccatcgccaaccttccaccaaagtagatacgtcggtcgccgtaagagttcgacgcgccgtcggcggtcggccgcagatttttagtagaatgctgggcccaagtcgcggcatcgaggttcggactactagcgagcgccgacacaccattggagagccgagattgtagactctgaagttttgaagcgaggtttgtattctgatcaagggtacatagaatttactggtagtacaaccttagattgttggcattccaagttcggagaatggcgcttccttctagagtctccagtcggtaagctctcggcccataggtgtctgctatcttgtagggtccttctcagttcggagccaacttttcctggtctagaggctttgaaacttttgcttttcttaagaccaggtctccaggcctgaaaagcttcggcttaaccttgttgttgtagtatcgggccactctctgtcggtaggaagccatgcggagttgagcctcgtaccggagttcgggtaggaggtccaagttggccctccgacattcggagttgcccggctcttggtactggtcgaccctagttgatggtagcccgatctcgagcaggatcatcgcctccgtcccataagccaagctgaaaggagattcctcagtcgggacacggggtgtcgttcggtacgcccataggacggaatttaattcttcgacccagaggcctttggcttcattcagtcggatctttagcccatgcagaatggtccggttggtcacctagacctcaccgttggaccgtgggtgcccgaccgagatcagtcggtgtgtgatatggaatctcgcatagaactcccagaagtcccggttgtcgaattgttgtccattgtcggtgatgatggtatgtggtagtccaaacctgaagatgatagacttctggatgaagtcttccatttttcgctcagtgatctgcgccagaggttcggcttccacccatttagtgaagtagtcaattgcgacgactatgaactttctttggtcggatgccggagggaaaggaccgagtatgtcgatcccccactgggcgaagggccatggggcaacaataggagtgatttggttggccggtcggtgttgcaggttagcgtatctttgacatggctcgcacctccgaaccaactcggccacatcccttctcatggtgggtcagtagtaaccctaccataggactttgtaggccaaggatttgccccccaagtgattttcgcagatcccttcatgcacttctctgagcacgtagtccgcatcggtcggtcccaagcatctgagcaaggagagagagaacgaccttttgtagagtcggccatccattatcacgtattgggaggccacccatcggagccgtttggcttccatggggtcttcagggctgattccgtcggtcagataccagacgatcggatccatccagcttggttctgctgctaattgcagcaccttctcagccctgttgatgctcggctactcaagactctccaccaatgtccgacccaaggcgtcgtaggctgatgtcgcaagcctggagagtgcatcggcccgagcattctccgtcctgagaatgtgagagatctcgaaatacttgaggtgtgtcacgagatctctcaccctctggagatattttgccatggtcgggtctcgcgcctcaaagtcacctttaacttgccctacgatcagctgggagtcggagaagattctgaggctgtcgatcccaagctccttcgctatcctcaagccagtgaggagtgccttatactcggcttgattgttggaggttttaaagtcgaatcagagggcgtactcgatgaccactccctccgagttggttagcaggaacccagccccgctccctcgagcgttggaagctccgtcgatgtgcagcacccaagtagacctggggtcaggttcggggattgcaacttctctggggctctcgcctcccgatccctgatcgatcgtcgggcactctgcgataaagtcggccaggacctaggctttcaaggctgaccgtggccgatactgaatgtcgaactcactgagcttcattgcccatttcgccagtcgtcctcatgtgtcggggcggtgcaatatcgccctcaggggttggtcggtgaggaccacgatagcgtgtgcttgaaaatacagacggagtcgttgtgcagacatgatcagggcgaatatcatcttctccatctttgagtaccgaacttcagcttcgtggagcactttactgatgtagtatatgggttgatggattcagctcttattctcccagatgagcaccgagctaaccacctcaggggaagtggccaaatagaggtacagcatctctctgacttctggcttcacaagcagtggcagggaggccaggtaccttttcagatcctcaaaggcccaccgacactcatccgaccaagagaagtccttcacctgcctcaggattttgaagaatggaaggcatctctcagctgaccgagagatgaatcggctgagtgcgatgatccttccgttcagctgctggacctccttcttggtgtccgggtgccgcatgtcattgttgtgatccaagtgctgtgcccaaagcctaggggaccaaggctaaggccaaggtccatcattcatgagggcttcatggaggctttagggctagttgggccctaggttgaaaggctgtgggcctttcgggttcttgaggtctaggttatgtgggcctcaagagaccaactctttatggatcaggtctggacccaggataggtgagattaggtcgagtcatgggtgtacatgggcttgggttaacctaatctcccatagagttggtcaagggagttttgggtttgggtcacttgaccctgtgtttatatatacatatactgtataggtttgattaagccaaagaatacgaaactctttctcccaagtctctctctctctctcttctccctctctctccagctattctccatgccccaggagcaagaaatcctagggtttcttgctgccgggtcccaaaaaggcaggaaacaaggggaggcactacctcctccccttttgtgccaccaaccatttcctctctccctctcttgcagccacccaaacatcaggtccaagacttgaaatctcttgcgaagaggttggtacaagtttttctcagatctggagttgatctgaggtcgtttgaggcacgggtgagatctccatcaacagatctacaagaaagactacagcaggacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgctgcacctaaggtccgtgggaggagccgagatcatgcttcaacatgtcgatgattgcctttattttctcagagttagcctcaattcctcgttgagaaacgaggaacctgaggaacttccccgaagtcaccccgaaggtgcacttagtcggattcagcctcatctggtgttgtcgtagagtacgaaaagtttcttcaagatctcaaacatgatctgtagtctacgcactctttaccagcatattgtccacgtacacctccatgttgcgcccgatttggtctttgaagtccttattgatgagtcgctggtaagtggctccggcgttcttcagtccgaagggcataactcagaaatagtaaaggcccttgacggtcacgaaggctgtgtgctcctcatcttcggacgccatctggatctgattgtatccggcaaaagcgtccatgaagctgagcagtcgatggccggacgtcgcgtctaccagctgatcgatctttgaaagtgggaagctgtctttcgggcaggcgcgatttaggtcggtatagtcgatgcagatcctccatctcccgttggcttttttcaccatgacaatattggcgagccaatcggggtacgtcatttctctgatgaagcctgcctcgagtagcttgtccatttcctcgtcgatggccttctgtctctcgggagcaaaagatcgcttcttctgcctcaccggcctcattgctgggtcgatgttgagtcggtgagtcatcatctccggggggatgccggatatatccgctgctgaccaggcgaatacgtcggcattggccttcagcagctccactagctgtcgttgctcggggtcgggtaattgagatccgacccagaccactcgttcgggattctcctttatcaggacgggaataagctgttcggccggttcgccccattcttcctctccccgctggttcaacttgtcggctgttagggagtcctttgcttcgttacttcgagcagagatctggaagcatcggtgagcgagctgttggtccccgcatatctccccgactccatttttgatcgagaatcggaccaacaagtggtacgttgagactattgctctaagggcgtttagtccggaccttccaagtatggcgttgtaggccgaagatactcggatgactgcaaaagttaggtggatggtgcattatcgtggttcggttccagtcatcacgggaagagtaacttctccttccaccgtgacggcttccccggcgaaacccaccaggggcgcggagactctttcaagccgatcagccgacagtcgcattcgggagaaagtcgagtagaacaaaatattagtgaaacttccattatcaacaaagattcttcttacatcataatttgctatcgttgccgaaacaacaacagcgtcgtcgtggggagtttggattctccgagcatcttcatccgtgaaggtaattgcattgtcttggcgtagcttcttcgtcggctcccctccagcagtcatccccaggtccaatcgtttggagatcatgttgatgaccccggccatgggctgattgttcgtcgcctccttagttggttggggtcgtcggtcggggatgggtcgagtcggcgggttcctacagaatttttcgaggtacccttattgtatgagggcctcgatctcatccttgagctggatgcactgttcggtattgtggccgtggccccgatgaaatcgacagtacttccaccggtcgaggccctttgcctttaaaggcggaggccgtcgcaaatattctttcccttcgatttccattaagatctgcgcacgaggagcagagaggggagtataagagtcatacctgggacgcatcagcttcggacttcgccgtcgaggcgacctcgagctccatcgctggggtgagacatgtctgttggtcgggggcccgctaggctcgacgggggcccgacctttccttcgcttctccttcgggcccttggcttcggtcaggcatcggtcggaagctccttcgtctgcgcgcatatatttatacgcgcgctccagtagttcggcgtatgtccgggggaggatcttatccaaggagtatgtaaatcgagacccccttagccccctcttcaaggctgaaatagcaatgtcttcgttgaggtcccgaacctcaagcgtggccgcgttgaatcgcatcacgaagtgccggagcatctcattttctccctgtttaggagaaaaaagactgtccgaggttcgtggcggcttccggctgatgctgaaatgggccacgaaagagtgctcaagctgtccaaaggagtgaatacttcctgagcggaggccgaagtaccaggctctggcagctttgcaaagtatggcggggaagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaaagaatcaggagagatcagcgatagagagagagagagagctagagagggagagttcagaggcttcgaaagaacctcctccggcaatgttgccttccccgttttatagtagagcgcagcatggcgccgtcattaatagcgcagacaatggagagttgtcaaatcgccggaggctgtcagagccgtcgtggggctgtcaaatcactagggttgacccatgtccagggtaggacgatgtcccaaggcggctatgccgcacgcctctgtcaggacgggcgtccttcagcagtcatacggcgtctagagaagccgaccgaccatacatcggcatttggtcataggatgtcgggtaggtacaccgtcggctggcgcggcgcattgcggggatcggacatcggccaccacccccgatggtcagtctgatacgttgccaagatcggaggtcgggccgtgtcgttcggccagtcgggaacgggaagggtcttcccgaccgacataccttcggtcggacggtgtcggtcggtgcggtcggtagagtcgggcgccggttaggtgggcctaacggtgagtcggcgcgagagcgaccggtcggtatatcccaatagttgtgtctccccaaggttctcgtcttgttctagattcatgaaatcaccgtttaattggaagactgttcaattgcatgctctcatgggcctgagttctccacttcgggtccgacaacaatattgtgccatctacaacagcaacggctacttggcaaagagattcaaagttcaaaacagtatcgagtcctctatatcaaaccgaccagatgttctcagtcaaaacaaacatcggaattgcacccccttccttgttgcttttccacgtgtcttggtcggaaggcaccacaatactgcgaacctcggcaacctaaagtggtaccaccacgagcctgcaattctgcaatgcgtaggcaatccactttcgtagctttgtggaaaggtggatgagttcagaggaagaaagtaccatcaatatctaggctctgattggtgcactgctgctagttctccaagaacagcatttccatcaggctctagtgccatctttagacttgtagcttattccaccaaggtctgatttcatacaccaaaaccattataagtatcttatttagatgtttcagtgaagtctgtaatttagaataattaagtctaatcctccatgactcatctatcttgtagccaatcatgctgtttggtcggccatcatcatatttcttgcttcaattcagatatccgaatggcctcctataaacctgtggagttcacgcgtatttatccaacttttttaaagaaagaggagtagcccactttctttgagcatgatgacaattgagggggagatggcatttgaaaatggaaaccagctgcagcacccccacttccattgacttgcgccacacacaatcaatccaattcttttttagtaaagttcttcacctaaaatcctttttagcttttatataatctagagttgcccattaggcgtttggtgacgttgttggtggtcattaccgtcctttagtgcattaaaaacgccttgtttctggaccagatcacgatcaaacacgtggtggagacaatgaagtgcgcatgcacataggcttctagtatcaccttacatgcaagtgtgtgcaaaagtttgatcattttctagttggatgacaattcatgcagctctagggacccttttgacttccgttggaagatcattatcttaattcctggtggcattaagctctagtggttatataaattgcctcttttcatcagaagaatattctagtcctagtgcaatcgtaatgcaattatctatctatctatatatatatatacccacctccctctccggtcattgcaatcgcaatcgttcttcaagttcctctggagtactcttgaactctttctattttttttgtctccatctcattgtctcggactcctaaacaagctaagatagtattgcatcatttttgccaccttccacttttctacatcatttgtagaattcaaaatattgaggatgattgcttcttatgtggtgaagctgttaatgttaattgaggtcctaatgagtggagctaggcttcatgtcgatgctctatccatgggttattatgatatgagctgtcctatcgcagagccgattgttagggatgttgtggatcaagctctgcgtcaggatcctactctggctgcaggactactgagaatgcacttccatgactgtttcatccaggtttgttttattctatctagtttctcctgtgctgctacttattttctttgaacatgtatgcttcttggacatccattacgttaattctgaggtcataattcacccaactcaggagacctgccaaaaaaaaaaaaaaactaatatattgcataataaattgaattcataattcactaatggataacaatccaccttgtcaacctgcttccagaaacaaacactacatagaaagatttaatgagtaggaaaaattggaacagtctgaattcacaatttgaaaataggccagtgatcatgagatttccagtggatattgtttacttgaactgtttgttctaaatatttctcttcatctggatgcagggatgtgatggatcagttcttattgattctacaagggatagcacagcagagaaggactctcctgcaaacctaagtttacgtggctacgagatcatcgatcaagccaagcaaatgattgaggatcaatgccctggagttgtttcatgtgctgatatcctcgcacttgcagctagagatgcagttttttttgtatgacaaatatttcttctgccttctgtaatttttttttttttttttttgttgggtactaatctgtttgtttttaaccttttatctttgatatcattgttgatttctagtctggaggtcccttttatgatataccccaaggaagaatggatgggagcaggtccaaaatagaggacaccatcaacttgccggcaccaaccttaaacaccacagctcttatcaagatgtttggtcagcatggatttaacattgaggagcttgtggtcttatctggtatatattatatattttttgactgttcaattacatcattagtagggaaaccaaattgcatatggactgaataaaaggtcaaaatcttttaggaggaaatgaaacaaagaaaattctttaattgcctagtatgtaccttaaataagaaattcagtctcttaagataactgctgacataatttgccatttgaaacccctcaaatctttaaatgcactgcaaattcatgatatttttattaatttaaatagtttttccaaatagcaaaaaattaattaaaatttgtgtttggattggtggccttgagagttggatattagccatcataagttcatggaaatggtattttatactttggtgaaactttgtgatcttttcctctccttatatttttcattttagattcccttaaaacatcaatctgttcctagagagttctatttttgcatacaaaagaactatatacaataaaaactaaatgaatactaaaagatgcctcatttttttgaagtacttaaaacataaaatcagatctagactcctgctaggggttaaatcatcaccatcataagatgatacagtacaccatagccactttcagaattctcttatagtttggcttttgtattaggctatggtagtcactactggaccattcaggagaaggcatgcatacctgttgtctttatattgataataacttcagtcattgcctgcctctgttgttgtaggggctcacactctgggtgcagcaaggtgctcatcattcaagcaccggctgagcaacttcgactcaactcatgatgttgatccaaacttagattcaaatttcgcaaagtcgatgtcaagaacatgcagccaaggagacaatacaccgatgcctctcgatccaacaaggaactcattcgacaatgcctatttcaatgcactgcaaaggagaatgggactgctgttctctgatcagtccttgtttgcagacccgcaaacacgacgctttgtcaatgcttttgctatgaatcaagccatgttcttcttcaattttcagcaggcaatggtcaagatgggtttgcttgatgttaaggaaggggatgaaggagagatcaggctagattgccgcaaagtaaactaatggttgtttgtttcacttgttctagtttgaagcaaatctatgtaatcttatctttatgtctatacgaataaaatggagatataatgttatattgtattatagtatcaagtgatgaccaatgcaaaaacatggccagaacaagataaaaatgatggttagagagattgcatcttaatcaaaagtcttcgggtgtacttctaattttatctgcttgaagtatcaatttgttgcatccatccaagtgagctaaatatttatatgtgcaatttctttaacataaaagatatgtttaaaattatttttatatcttaatttattctgtgagcaatattattatatattatctattttatatggttaacagtagttatccatgtagtaaaatatagtcggctacatttgatccagatccaattcgaacctaatcaagatccgataagcaaactcgagtttttcaattgaggtcagatagtatatggacataagttgactcgaataatctgttgggttgagaattttggctactaagttgagtttggatctaatattaagactcgatcaaaacatcggattaaatcatgatcaacctaatttgataagatccatatgcattcgtagctccgtttggatagtagatccaattggaccaccaagcggcacgatcggggctcgtccaaaatcaaacacctcacgtgcaaaacagtttgcttcccaagctcgcaatacacggcagtacaccctcaaataaatcctccaccctacaatccttgatcgggctatcggccctgatcaacaaagctgggcaaggaaacaccgcaaaatcggaatccagctcaagattttaaattttgaattcgttaggatgccattacctgcctaccggcgaagaaggtatcgtaatcttatcccaatccctcgattaataccctaaatcctactctccataaaagtataattaaataaggaattatctatcaaatttaacggcgaattcacgcaaatgggggcccatccaattgtcaaaatcccaccaaatgctcactaggaatttgcgtaccacaggcgcggtgtagagcacaggaccttatctaattgatccagctatctttttcatttaaaaatttgtatgataaaaatatttttattttttaattaaattataatattttatattcatattacaatattttatatctaaaaagttataatttttgtccatatataattcaggacgtaatatgaacaggatgtcataattttttctaaaagatgatgatattttcgtcattcaaaattttcaaacgaaaaaattgatttataggcattaaatacgtgttaaaatatttttggacaaaaatatcttttctatattataatattttggatcatattataatattctggactataatactacaagatattgtaatttttttaaaataatttatgtgtattaaaaaatgatgattacgtagatcaataagataaaatgatagatcagctaaggtaaaatggtgtcccccatatcgatttttttataccacccagggtgcacaaaaaatttcttatcctcactgattcatccacgtcgaaatcaaaaaaataatcccaaaaaaaagaaagaaaagaaaagtaataaaaatgggaggaaaagaaggtataaaagtatcaagaatcaagataataaataataggatcaaatctctgggaccgatatgtcaaaattaattacattttaatcagtaacaactgacataattaaattctcccaacccctctctcccttcctcctctgtatataaacgcacctccccccacctcgtctcctctccttcctctgtttctctttggtctctatttctttcttcttgtggtcttgtttggggattgagatcgagtaggaaggagatggcgaaggatcgggcgagcggatcggagggagcaccgttggtggtgtcgttcggggagatgctgatcgacttcgtgccggacgtcgccgggctgtcgctggcggagtccggtgggttcgtgaaggcgcccggcggcgctccggccaatgttgctgtagccatcaccaagctcggcggctgctccgccttcgtcggcaaggtaaacgtcccccccgttcaaaagatctgattctggctccacttcaccaacctccgcactcttctctctcttgctctcgttgtatgtggtcaccggcggtgcggatacgagatctgtgatccgagctcgagattcgttcgtcggtccctctccccgggttccggcaacccgtgccgacatcgagatcggaggtgttctggaccgtccgatctagatcggagtgacggaagccatcgccagtttcttttacttttttcgtcgtttattatacgtctttctgggggcaaacgtgcgccgtccagcgtggggtttgacccgagagctcacgtgattcggtcatgtgggccctaccattgcatggtcgttggatctatcagatggacggataggaacggcaccttccggtgttagatatacactaacatataaaactttgaccatattttttatattaaataattaaaggtgtgtttggttacacgttttgatttttgatttttaatttttaaaaaataatttttattttttaattttattattaaataaaaataaaaaataaaaaatatgtttaagaactaacttattataaagtaaaaagtaacatttgagaacgatagatgaaaagatcgattggagaaaaaaatttaaaaaaggagaaagaaaaaagtagagagataaagagctagacaaaagaagaagattcgagcaggctctttatttttagtttggcgtttagatgtgcaaaagtaaaaaataaaaataaaaatttgaaaaaataaatttttttattttatatataaaataattattttaattattttaattttaattttttactttgcatgatgttaccaaatattattttttaatttttattttttaaatatttataaataaaaaatatattttttaatagctaatcagatatattttaaataaattacaataattaccttttaaattgaagataattatagattctccattcaattttttagacatatatattctgctatctaacttttattagatacataatatgtaagccttgtcaatatttttttattaaataaaataataattttattattatcatcactatctaatctatttaaattttaaaatatattacattttttatttttatatttttatattttttaaattttatatttgaataaaaaattttgtatatatttttgaaatattaggtggtatatataattacctccataaaaaaataatttattctaaatgactaaagtgtcagcacggtgacaactccgctaccgctggaacaattgcagcctttcatctatgatgttagaggtccctatcacgaggccctaccgggctggcacttgcgctggtggtgatctcaggtcccatgcgcctgccagaaccacgatgccacttataatatatactatatgcatggaggactttatgtatataccaagtcaatccagattgtctaaatgaaagtaagagcaagccgacaagttcaaatatgaatagttaggtagcgagctagctgcatttctgatgagccggtctgcatacagacagacaataaaaataagatcgatgtaagaaccacataggtacatcagccacatatgtgtatgttactgttagccggtggagattgattttatttcaaaaaattaaattaaaattattataattaaaaagatacatatcaaaaaatcgacgcacgatacattctttttagcatggtgagaataaaagaactcctccaccgccccccctcccccgatggatcttaccttcatacgactgaaaaataacgaagctatccttagttcaaaaaacccatcgagcatatatgtatgtatgtatgtatatatgtatatgtatatgcatgggtgtgcgtacgtatgtgtacactcggaaaagtaagagtggggaccgacgctgaagagcagacatccattttctgcgcttgggcaacaacgtgggtggtggtccgtgcgcaagtgggaattagtaattgttggtgtggggtccattgtttgttgcaccctttttttttttttatagtgaatttataatatattatatacataatgtgaatggcttttatatagtcagtgcttagatcaagatgaccttaagtctaggaaaagtttcaccaaatatattattttataccggtatagatggatataaattttattttgcattgggggaaaaatgatgttatgccaggtaataattgcagttattctctttttgtgtttggatgagatttatctatagctatacaattaactaatgaaaactctagtaccattatattttattatatatatatatattacaacaactgttgattatttgaaatttaatatggtaaaataagtgtcatataataaagtattaaataatatattattttgattaatacagtataataccatttcatctttccttgattattaatatatcatgtaatataataatatcttattagatattataataaagagaaaaatataatataacataacataatatgggtattatacattgtgatattacagattacagtaattatgagacaattatactatatcatagtattatgtaaatattgcagtagtattttttattcattaattattgattggatcacatactttggaatttgtttatttgcttttataatgttgtaaattggcagtataagatcatgtaagtatatgactttatatttctttaccggcaagaaatttatatctatttcattaaataaaaaactggatttgacacaaatatttcagagcacatagatcagaaataaggaagaaaatgaatattacttcacagacataatttagaaaatcggaggacataaatgaccctcaatatacataattgatggctgcccataccaaaatgatgggaaaatcacaataaccaagtccatagtaggtctcctcctattggcaacttgataactgagaagggcattcttcaaagaaaaaaaatacatgaattgtgagttaggctgttgatctcctgaacattttcacataaatagttatctattaaaatgaaattcaatcacataaattattaagctttaggcaatataattaagtacaataccattcaaacaatgttcatctcatgcctcatgagtcatgagcatacctgcagtggagcatgagtagactaaccctcacttctgacaaaatattataagctgaacttcacgtccaatacaagattggcatcttcatttggttatgctggctgcatgccctgaatagatagccatacctggtttcaaccatcagaagccagtgtgtcatcctttacccgcatcagatagcagcaactgttatttggccatccaagtttgtaatccattcttactaaaataattcaaagccaacacaataccatcattttcaaaatggaataaaaattgaaagccatggtaaactatgtcatgcatatcataggcaagaccatacagaagtagatggagatccccagtctttaacttaaatacatgtttgttttcatgggatgactttgatttgagggaatgtaggggtcctagaccagaatgagtcagaacaataattaggagtcatgataatcatagacatctgttgaggaccatatggtggcagtttttctttcttccccttcttttctttgttcttcgtctgagttacaaggcttgcgaatagcctaactgggctaagaaatctagacattttctagatattggaaagaaatcacctgttcagaccaagacaataagatcctgtcatatatgttccactttgaaaccgttatttgctgttatgatggcaataaatttgcccagacaagccaatagatggtctttttggtaaaattcaatggaaattactcaaatcttggtttgaacagtaaaaatgtaaatataatggaccagaacatcacaaaaaatagctcttatttttcttacctgaccaccagcacaagcaaggtagcagctagataataacatatctgttatagaagcaatgtatgatagcacatgcaggtgtactggctcattttctaaaccacgttttagctggataactcaaaaaatatggatagggagataagccatcttcgccaattccccgagctcctctcttcaccttctttactaattcccagctatttggtagatatcacaaaggataggataattgagcaaacattgccttaggtcatgttttgaagttccaatcaccttatccattacatatactccatgcagctcagttttgcagggtagtgaaagggagagggtagtggaagaatctgtggcctctgctctcacacctaaatatatacatgttttgatcctcttttctctgaaacatatcattagtcagtaaatacctattgcagttggatactaaggtacatatctaatttaccaaacaaaagatgcttccaacatttatttttactgtgcttgtccatatttctcatcattttattatattactaaattgtgtggccattgtgtccctaatctcctggcaactgctgcaagtttgtaaatgaagtcattcatcacttttatcgttttaaagatctgggtgaataaagtgaataattggtgcagcaatagaataggatagtgactagaaaacatattccaatgctaagacacaaaactcagcacattcttctctttattacatcacagagagaattttgaacagaatctgctgaatgttctcaatttgcaatctaataattatttttttcaagaaaaattagacttctatggaacaaaacatgctactattgctgcaaaatgacattgttatgtatcatgattcaaagcgttggtacaaaaagcagatgcttatctgttactcatttcactttccactgttgccaagtgattcatatatttggttttcaaacactttcttcttccatcactgcagtttggtgacgatgagtttggacacatgctggttgacatactgaagaagaatggggtggacactgatggttgtctcttcgacccccatgcccgcaccgccctggcctttgtgactttgaagagtaatggcgagcgggaattcatgttctaccgcaaccccagcgcagacatgctcctgaccgagaaggaactcgacctttccctcattcgcagtgctaagatcttccactatggctccattagtctcatagctgagccttgtcgatctgctcatcttgctgctatgcgtgctgccaaggaggctggcgtcctcttgtcctacgaccccaacgtgaggctccccctatggccatcacaggaagcagctcgagatggaattatgagcatctggaaggaggctgacttcatcaaggtagaaaatatactcctcattgcatgtaagaagattaacaaatttatttggtgatattttgttaggaaacctcacttgtatgttctggccttggatttaccaaagttggagagcatgttatagccacctcttgtcttgctagccaagacaaagctgaatttctagcagagacaaaaggtgggtcccatgatatatggattccaagttggtttgtagtggcgtcttatgttactaaatgcagtcatccaagatttcatctagcttgaaaagtgtctagatgatcagatatgaagttggttttcaattttaaactttgggtaatgtgttgcggcaggttagtgatgatgaggtggctttcctgacacaaggagatccacagagcgaggatgttgttatgaaactgtggtatgatgggttgaagttgcttattgtcacagatggcgagaagggatgcagatactttactaaggtatattgtccttaatatcctattggtatttgttaaagtagtttttttttataaaaaaactcaaagaaaaagcagtttttttttaaagaaggaaaaagttatacatgctcggaattgtaggtatatatatgtttcaaaaaggtgtataatttagattttatatcttcaactttgtaggtcctaactttctacattttttgtctttttatatgtagaatttcaaaggaaaggtacctgggttttcagtgaaaactgtggacacaacgggtgcgggtgatgcctttgttggttcccttttggtttccattgccaaggatgactccctcttccatgtacttccttctgccctctggaatcagcttcttgtctgtcataatattacaatcttttaacatcagtgtcattattcacagttattattattgctttgtacctgtagaatgaagaaaagctgaaggaggtgcttagattttccaatgcttgtggagcgatctgcaccacccagaaaggagctattccagccctcccaaacacatccatggctcaggagctcattgcaaagggaaagtagggtatcagtgtgcatgatgaactaaggggaaatttaggtttccttgttagttggttttgatgtatcctctctggttagtctttgtgataagcatcagaaaattttcacttgttatttggtgccactaaatttaacctagtttgtctttggtgcaataaaacttccatctttttggtttaatagcagtgtgtgaagctaccatatatcctttcctataatattaaatgctgattaagaattgtccattagcacaattggatacgcattctcttagttactatatttgtgaggaaaacgaagtcagatgatggtatatctataaccatgtactctgagaacaatgcatgatatagttgtgactgatgaattgttttgtttctgcttcttcctaaatcaaatcatgttgttctctaagttttaagaaggctgaaatgcaagggggactttggttcttttgttcgaatgaacaacctaactgtgagttagaaattatttttctgacatagaagagggttaaactcagccaccgagaaatgctttgtgcaccatgcacaccgcccatggtgattggcctatgcatggggtcaaaagaaaaaaaaaaattttttttggatgccacacctcggctccgtgagccaatcaccgtggacggtgcacaccacctgcgatgcacaaagcatttctcctcagccaccccaccccctcccccagcccaacaaccacactggtttaggcatgatttgaacctagatcatttaccaaccagattagttggaaccactaaatactgttctatttatattcatggctaattagctttaccaatgaagaatttaatagtctacctcagcttaacaagaaaagctccggagttccttttttttcttttgttgtgggggggggggggcggttgtaaagtggtgcttcgttcacgaccgaattcggaaatgcactggaatataaattggaatgcatatcttccgacatgtttgattcgtgatttgaatcaaaaataaaataaaataaaatttggataccaaggagaagtagatattaagtgttagatgattaaggtattctcattttctcttagaatcagaatcgtcataggactctaccaactaatctcaaatccggaatataacacggtcatgctatcgcaagatgttgctctcaataatatgaagcctaacaatcataatcagctaaaatccaatataaataaaatataatgttatcgcaaggtgttgccctcaataatacgaagcttaataatcataatcaattaaaatccaacataaataaaatatagtaaaagattcaattccatcatttatcatataatcaaatcaaaattggttcagaacatttaaatcgaaaattaaataccaaactcatatctcaaaatttataaatagttaactataagtctatgatcattaaataaattaaaatttagctacaaaaacttcaaactcgctagcgtagatcctcaagtctggatcatcttttatttttaatctctatggaagaaaaaaaaatatgagctacactagctcagtaagtagaacctacacttccttatcaaatcaaacatatatttttctatgataatacaatatttagaaagtaacaaataattcaaaataaaatatttcataaagtataaaataagtcataaaccagtcgtgcatgcatgaacattttgtaaatatgatttgtaaattattcttatcagatattcgtgtaatgtttcaaaaaattactcatagatattcatactatggtcattttatatccatgacagggccgtcaacgtagtcgataagtttcataattcgtattcgttatcaatgttatacacattagcagagggtcatttatgaaatttcatgatttatgcatgcatgactggtttatgacttattttattatgtatcttatgaaatactttattttatattatctgttattttttaaatattatattatcatgaaaaaatttatacttgatttggtaaagaaacataatttctacttactgagctagtgtagttcatatctttttattttttttcttttacaaaggaataagattagaactgatgaaggatctaaacttaaggatctgcatagccagcttgaaaattttgcagctgaaatttagtttgttgattatcatgcacttatagttatctatttatgaattttgaaatatgtttgatatttacttttggatttagatattctgaattaattttgatttaattacatgacaaatgatgaaattgagtattttattatattttatttatgatagattttagctaattataattgaatggcttcatattatcgagagatgtatctctcgatagtataaccgtattatatctcgaatttgagatgtgatatttaataatatcaaaattttctcctaaaatcagaatggccatgggactccaccaaccaaacaactggaatgatctaagtccaagaatgacctgctagtttttttttataaagaatgatctgcaagttataccaagtattcaatcaacttcagctacgagacaagcaagccaatagaattcattatctaaataatattaaaaagaattatttataaaattaatatatatttaaatttatttatcaaactaatctaaattcataaaatatcatttgaaatgatattttttttgatgaaaaaagtcattccaaatgatattttatgggtctacgtcacctcctcccccatcctccgtggactcaaaaaaaaataatcaaaatcaccaatagaaatggtatttttgaaagtgccatttgaaatggtgttttagaaatggcattttcaaagacgccatttcaaatgacgttttcaaaataaaaaataaaaaaataaaaatagctatttgtaatggcattttttgaaaatactatttgcaataatattttcaaataaattttaattttaaataatattttcaaagcccttcgatggcccaaaaaaataaaataaaataaaaaatagaaaaccaatccatatcatctccgtaccaaccaataccgatgccataccgacctataccgatccaaaccgcatcgtatcgagcggttggtgcctgcaccataccgtaccgatactttaccgacctgtatcggcccctaccgcaccgtatgtagcggttcatgctcgtaccatactgagatataccagtgcggtccgattcatctcatttatccgaaaaatcggtctgaaccttgttggttccccaccgatatggtacgatacggccgtaccgatcggtttgagtcggtacggaataccatgcatccaactgtagtcctagtagatttgagtccgacacaattgtcccatcattccttatcaacttggaatcctcatcctcatcatgattcagaatgctcttttcgtcgaaatactgcagtctattatccgattgtcaggcttcaatctttcatcgaaataagctctcaccatctgcttcgcaatacgtgcataaaaatgtatcacacccttaatgaaaaaagatgagaagagagagtaaatgaaagcaagcataaaggcggagagagagctgtgaatatcagatgacattctatcgcagtctcccttcataaataactgacttgtttgatttagctaatttttagctatttcaagatatataattaaattatgtgatatattattattattatttatattataatttctatagcccttttagcataactttttctttcctaatcttttgagacacatgaaactacgtgtatccatctacaaagcataacatctgatcacttgaaattaaattaatctttgataaaaataataattaataatataaaatagaatcaaaatatcaagtgtataaaaaatagtacaataaaaattttaaaaatactaagtacaaatctaaaaaatactaagtcccacaaagacgtcatggtacccgtgattgcttgggtcttcttaggaaggtcctcaacggtcgctcctactcctgtatctgctgtgatggctcctctcccatatcaatggaggtctgctgtcatgctactcaagaataactgatgctgtcggagcatctgcaggttgagtgaccccctcaaccccctcatctggatatacggatgggcctgaaaagaaagtgtcatactcacgtggctaactgatatccgatgatgttatctagggcatgtaggaagaagaaggtcctgtcatctgtggatcaaaaggtggtggcatccgtgcagcgtgtagtgatgatatctgtggaatatgcagtgatggcatatgtggaacatatggtgacggcgtatatctcatatctggcgtatcgattgctccatgccaaagcgcacagctatctgggtcaacgtcaatcgccaccaatgttttcgaacttattttctctatctcatgtagtattcagatccgctcgtcctcatcagtcgtagataaagcacgacaagcatccaacatatggtctgatatagaatcagtctacataataaaaataaaattagcaatatattgtaaaatataaaataaagatataataaaactacataaaatattttacaatcttaattattagaagtaaagatattgatataaagtataatttttgtgatcttaccaaaagatgcacagcagaactctcatcctcgtatcctgaaactgcatatcaaggctatccaatgactcgcactgtaatactaaaaaatcaaaccatgtagtcctcgatatatggacggtctctcaaaatgggatcaccatgaactatgtgatctcgacgtgcatttcaaatggcgatgtactctgcatatttgatacgccagtcaatatgagctctccttcatcgatcaatacgatgaagtctctggctggtatcaaactactttgagatgccctgaatctaaccaaactgtcgtttgacatgatcgaaaagatgccactccaccatatcaaaacaaataagtgacaccctagcagtccatatatcatgtccaactatacacatctgcggcaatatagccaatatctcatctgtattggacaattaggaccagcagtaatagaatgttgttttgcaaatatggcctcaacactatcggtttgcaccataggagttacgaaaggtgaagaaggcctaggagtattgtccttttgggttaaaagccgactatagtatccaaagcccggtacatctttcttttcaatatataattctaaaaattgacattctgaatatttcaaagaaaatatcagtatttcttggacatctttatcgtcatcaattggaactaagatatacttgctctgcattaactgtcccgacaaattagaagatctctatttcaattttatttcatatttttttttatctacagaaatactactgtataaatggtccaataattcttgacctgataatgataaagatatcttaatcatctgatttgtaaggtgactgtactgcacgctatcttcgccattctgtattatgccatcataacacaatagtagatgaactcgaatactgaccattttctcagaaaaatctatgataatatcaaaatcaaaaaaatttagtattaataattattttatcatttcaaaagacttacatgataaatgcatcctatcatcaactaatagacaaagataaatcatatcccattcaggaattgcatcaattctataagttaattacagtaatcaaacgatatacaatagggaccgaaaaaaatttcaacagtattttttcttagttctcccaatacgactgaaaatgtatgaggagaactaaagaaaaatgctatccaaaatttctctcgaaccctcagcatattgtttgattactgtaattacctatagaattaaatataattctcaaactatccaaactggataatcaattaaccactgtatatattttacggcactcgtacaaaaatatataattaaattacaaaaatttttctgaatttaggttgagattatacttaaatccattattttgaaatatgtacacctacagctcggcatttacaaaaaacctataatttagtccccaccttaagagggtacgtgtagatttttcgtagacgttaggaatgtaagtgtaggtttttcaaaacgttaaactcatgtggtaatttcgacctaacctcaaataattttttataatttattcatatatttttgtatggatgtcatagaatatcctacattggtcaactgacggatctacagttctataaaatataatatatttaaaattcttaaattagcctaagattcatttttaaatcaagtctaaatctatttaaaaaatatatatagcaaacaacaatattaaccaaattgattagcgatctctcatacattgcaaataaataataataatgataataatgagataaaaaagataaaaaaataaaaaagtggtggtggtggggcaggaaggtcgatgggaaggcaccgaccgggagtgccacgatgggagagcgtcgggcggggagggagacccgccaggggtggtgaggggggcggccgctgccgacagaggacaaaaggggggtggttggggaagggggtccgccgccacccgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaggagatgggggggcgatcgccgctggaagagggagagaagaggaggaagagaggaggaaagagagaagaggggggaagagagacttactatgccatggagagggagatcaccatcggagagggagagcgccaccgaagagggggaaggaagatatatttttttttggtatataagatgaattaacgccatttgaaatggtgtttttaaaaacgtcattttaaatgatgattttgaattttttttttttgatccacggaggataagggaggagatgatgtagacccataaaatatcatttgaaatgatatttttcaccaaaaaatatcatttcaaatgatattttttaaatttatattaattctataaataaatttaaatatatattaattttataaataattttttttaatattatttgaataatgaacttcaagtcaatataagtggtgtcagacaaccaaagacattcaaacagttgaattgatggcacctagggctgaaacacacagcgccaagcataaagaaaagggctgttttgaggttgaaactaatgtgcttgttgcgtatgatgtatttctttctttttttttttttttttgaaatgaaaatatgggggtgggagagagagagagagagagagatgatttgagcaataaacatagtgcaaagcctttgagaaatggtacatgtacattaaattagcataacattgcttcttgaaaagcaatgctcgtatacaaggattcgttaaaaaggaatgtttgtttacaacaatgataattacatctaaacaaatgaaattgagacgtttcaggttaatgaagttgataaaaaaaatcacaggttgatggctctggatgcaagatcacggtctcccaccaagtcaccctccaattggttagcgtctgcctgcgatcaccactttatgttacaaactgaagagagagaacattttctcttaaaaaataagcttgaaggaatatgttttagcaaggatagaaatagtataagcttggagtcaggcgatatggaaaacttcttatttccaaaattaaggtcatgtcaggaagttgatttgtgcctattggtgagaggttcattcatttcccttagtaaatcttcacttaaattgatgagacattcgcatgcacgacgcataaaatggcttcaaacgatgacagccttcctgaaacactagttttctcaaattaagaaagagaaagatggcttttggttactccccttgtttaaacttcaaaacatgaccattactaaatggcatataaagattcatgcatcaaagcacttgcttggatggtatcatcccttggtacttgcgtaagggggtgagggttcgattcctattcaagggtggggttgggtaaatggtataaaatgtggggattagctttttaccataaaaaaaaaaaagtaggggattagctcctcagaaatctcaaaaagaaagagggggagggcggggggtgcattgatccttcaccttattttgtgaaaggtagtgttctaatgcaccatctccttgaagaattttagctccacagcctggtctgtcgagggaaccaatggcctcctcatccaccacaactgcatccactcgctcggttcctgtctttacatctggaatctgggaaaaaatgtgcatcatgaaaatgggaaaaaatgtgcatcatgaaaatggagcaccgccaaggtcaccaataaatttttgatctcatgtcaattatggaaaatgaagaccataaattaaaatacttgcatagaatttaacaggctcaaacagttacgtatttttaaactttctttttactaaattggagattgtaagaatggttaaaatgcacaaaatcagtattggcattcaaaaaggcttcaaatgtattgggtaaggtataggctgccatagcactgctggtgcagaaatctgacatatatggtggcttgttttgttcctctctagtagcgcaagttgaagaatgcaaatatacaccctatagataagggctgagcccaagcaaaatccaacacaatttaaatttttgaaatggataaggggccagaacaggcctagttgtcagctgagacagaaacatttttataggccaagagaaagcacctgcttgggaactgaaatttgaatatggaatagggctaaagccaatggttctggcatcaagttccgcttgggtctacctgacctcattacatccaagacatgatttgatccaacctgtgttagctctgtcagatctacaatcttggaagtgcatgcagttcaacctctgcacaattaggatcaggccaaagctagtaaaatcaggtcgacttattgattcagacagacttgcagggcatcagatctacttgctcaataatgtttgatgcctatgggaagggaaaatatacatgtccactcggtgtcgcatgcatagactaaattgcagataagggtaattaatttacaccaaattttcagctctctgctattattttacattcaaaagtgttctaaaggcatcaaacccaagctcaatttgacgttaagatgttatgctcaaaggttcaaaaataatttcaggattctactgcacattcaaactcttcaccataagcttcttagaggtttaggtcaattggaagttacattgtggagcacttgcaagcaatggttttaattgctgcttaacaaggtaaaattttagaaacaaaagagaaaagtgaaagaaccattaatattagtcaacaaacatacctcatacatggcttcagtaagagtactttctaaaatagctcttaagcctcgtgcacctgtatttttcaccattgctttttttgcaatttccctaagagcagcctctgtgacatgcagtttaacctggaggatgatacaataatgagagccaaggtaagaagcagcttatttcagaggaacatagaatgaatactagaccatctacatagatgagacacgcttacattgttcatgctaaacagtttcttgtattgtttgccaagagcattctttggctctgttagcacctgaagtcatatcaggttaaattaaatgaatagcttcacaccaacagctttaaatgtcagcatcagcttgtcagtgaattaaaaaaatattactttaagtttgattagatattcatttaactcgatcaattagtacaaaaataccattttaagtctaaacgaaagtgagaacccagcttaggcaagtactgcatttagaggagatgctatccagattggaagttacctgaacaagttggtcttcatttagagccgacaaactaactaaaattggaaaacgtccaatgaattcggggatgagaccatatgctataagatcactactttcaacctacaaacataacatacttcttccatgttaaatgtatagagaaatgtaagagaattctcgtgctttgttaaagcatgggaaaaaagatttggacacttctagacgtgaaataaagaatataggcaaaagtttaaaacgaatacttactgattccagtaaggatgatgccactacagcattggttaaccaaccagttctcatatttgcacgtacaggtgccccaaatcctatcgaagaatcatgccgtctgtggaatattgaaaaataagaccttcctcaagctccatagtacaagcaccagagtttccagagaagactggtgcacatatctaacatcatgaaatagtgttacctttctgaaatggtcttttccaaatcaacaaaagcaccaccacatataaaaagaatatctttcgtatctatctgcagaaagcacatgcattagttaaagacatataaaaccagcataagtttaaagtatctgtgaagtgattcaaatatgaagtcatattactgcaaagttatgacaaacccaaaaaataattgaaaactgacactacacttgattgctcagatcatcttttttatttttcatttttttttttaactcttgaatgctgattgttgagacacttaaaaagatgggaagcaaaacttgatcagagtttaattaattattggtttgatgtagaaacattaaaaaaaaaaaaaagccaatttcatatctactcgagaacttgggcaaaactttaaacaaggaacaagtggacaaggcacttcatgcgattttgtaaaaataaatataaatcaatcaacaatattatagtagagctgtatatgaagacaattttatatcagttttcccttttttcttggtagtgacagctcaatttacttgttttaagaattccacgtaaaatctcatgaactgcaatatttacagcattttgctaatactaatcatcaccaaatctttgatcactgctttgtaagccaactaaattggtgttgaaggttgtacggaaggaggggaagtcttaaggtaacatagatagggttgtgagcaaagacatggagaagcttgaaataacattggaggtatcccaaaaaggactacatgggaaatgaggatccataaagcataccctaaatagttaggataggccggatgtttatggtttcgtaagccaaagaattataattggcagtatcatgttgacattgattctcccaagacttctcagctgaaatgttcccttttttaactttattttgaaagacatttttgtgaatatttctaatcagatatattctgagaaaaaaatagaaagagcatcatcattgttgcttgatgtatgaaaacaatgttcattaaactatatgctcccatgcatctgttattacgaaatccttctatgcatctgttgtgtgctaaagactattcctaggcccaatcttgcctactacgaataaccaccaataataagaagaaatatgggaagaaagatttgaaactaatggaaaatagatggcactgtttgattgagtgaataaagccattagccccaattatttcaatttttggttttaggattaggtagggttttgagcctatgatttggattaatgccaccaatgctggcctcagcaccggtgtttcaataaatgtttgggaaaacctaccttgagctcttcttctccctgtcttcctctcctttctctcttctcttttcttctctctcatgtaaaattagagacagagccctgggcattttcaccaagtcccagctttgacctggttggtactggctgacacagtcactgacccagttgatgcagctgatatcaacgaggacattgggatgccaggttcaaacggactttggttccgtagccatcccaggagccagtctctcaccagtcccacctaggatggctgggtaccagatcctcgatccataatgcaagtaatttcaataatctattatttaaatgggtgatgctctgaaaaagaaagaatacagttttcgaaaacgtttatcgttaaaagagcatatttggatgaatttcaacttcatcattttttctgtttatttatttccttcatagattttgcacatctatgcaactagtctagccttctcttccgaattgggtaggtatcttttaatggtcctttgtatgtttgattgatgatagatctttatcatacaaggataacttgcaagatgaagttcaaataatctttaagcacaagaattaaagattcaaccacataacatgtcaatctacatctgcgagactataaagcatgaaccaggatttacagtatactctgacttataaaagggaaagaataaaagatgctatggtttttgatggaaaaatgaatggtcatgatacaagaaaaacccatgcacgcaagctagactatgatggagattttaaaaaaactcctggtcatgctacaaggagcagcttgaacttggacaacaaacatgcggatctaggttccaaaaatggagtgcccataccatacttaaaacaaatacatcattcaaaggtataatttttaaaatacctgtatatggtcgttacgaggatgcttgcgagctcctttctcaggaacattgactatctggacaataaaatgttcaactgaattcaaaagataagataagtttctcacttactataaacttagtaactaacataattgtaactgacagtattcattcatttcaaaatagggcattcttttccttttctttcaaaactagaagaatacacccatcacataggtcaagattactttcgtatttaaaaaggaaataagattagtcatatttaaaccataatctggcaattttaagttcaaaagtataggttccagaaatgatttttagtcaagtctttggagataaaacattttgcatatcacaaccgtaacaaaagaaagattgcatagaacaaatgaaaaacaggtttctgagacacttatttgaaaaaatggggaccgtcatgtgaaatgctttttatgttctcagggaacttcaaacatgcagaggttgatatttaaacttcaatatgcttttaaaacattgattgaaagttttactcaacaaacttcatgttttattactgatcaatgcaattaccatttactctgcaagtattttctcaagtcataaagcatgagaatttggtatgtgcttatgaaaataaacttaatctacaaacattgattaagttgcctatgaaaagcagttttgatttaaggttacaagtcatatattgaagaaaggaaagggatataatttatgcagatgcaagttgtgaaattatgccaatttataattccattgttattgttgggaataacataatacagtaagagggcatgcaccaagggtcaagtaatctacatgaagcacatttcagagttaaacttcacagacagagagaggaggggggaatggggaaaaggctatttgtgtgcgtgtgtgtgtgttgtgtggcgggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacacacacacacacacacacacacacaacaataagaagaagagagagagagagagagagagagagagaactaaggaaacctgtagggccaaattagaattttttttttctcttcacaccaaaaacaaggggaaaccaattgaggcggaccctatctccatgtttatgatgcatcacactccttcaaattgttcttttcctcccaaccaaatttatatatcagcgaaccacgcttctgcaccaaaaggacaatttacaaaattttactcctttccaatcgttcaagtatgggaggtcacgttccataatgtaccataagacagaacaccctagaattccatctccacttaacatgctcagaaaaatggaaatcttgattctccagtttacacaataattgttgcttcactataaactttaggtgcatatattcttatcaaaaaaaagtgcatgtgtatcacatcataatcacaagcagtatttcgctaaaaggttgtccttagggcacagaatcgcatacatctttgccacgtatgccaccatgtattaataggtatcattctgtgtcaacatgtattgctttaatacgcatggatatatcccaagcacataaatgcttgcttgtatgacactttcccaaccatctggaatcttccctagtggtttttcttttgccttattttataaggattggagttttgaacatgataatgacaaaaatacatgggatgaaatgttagacttgaaagtaacccatagcattcaagcctctcacagtaccacctatcaccttgcaactcctaaaatacattgttgatgtgtaaacatagttatgtgtcgcttttgcagtttttgccatgaaattcatgacaatttatattgccaaatagcaaacattacagatatttagggtgatatacaattcttgcttcctattatcagttaaagaaatctttatttgtttaaaacatgtttatccacacatgtagagcatttaaaattggttaatattaaaaaaaatgaattatgaatcccttttacaacttgtgtatcatttttcaatccattaaactagcttcaagctttaaggttttactagagaagacttaaaatcttcacagatttgtcagttaaattgctatttacatgaagctctaccaccaatttttgactattaaaactggttttgaccctgaaaatattttttaaatcaattgaatgggagctaattctcccaggttggtatcaaaatgtcacaggttcaaatccccatttagaccattttttcttcataccacctgtttcttttcttctcttgacttgctcctggttgagacaattttgacttgttcttgagtcatgcatggtccaggctacatgtggttttagcagcataagcatttgtggtctagtggttacttaacagtcacaactctcaagtattatgaagtaataccaattgagaaaatattataaagtaatagtcaaagtacatgtcacaaacatggttcaatatgattaaagtaataggcaagtgtcatctaagaaatttatgatgtttacctcccaaatttttaaaaataccaaccttctaatggcaatgaatattcaaatgccatcatgtccatcattagttgaggttcatgctgtattaccagaactcgcaacagaataatagtaggcccctaagaaagaccagtttctagtgaccataatgcaaaggaatttttagaacatgacattactctcacatgtatgataactttattcaaaaaaataaagaatagaataatccagaatcataccgtaagcaacttgtataatattgattcgacatcttctccaacataacctgcctgcagagagattttactctttcaatttacagtaaagaatagccaggccaggaaggctaggaggttgccatcagcttgacaactattaaagcagaatggtcaaaaaatggtgtcgtttgctttctttagtcaatgttaacaaaaaaaaaaaaagagatacacacatcagtaccgattgatttatgaaaagattgaccatgttttttaatgtataaaaataaacccctaagaagaagaacccaaatgaaatgaacaacatttttgctataactaggattaccataagaaaaccacagtataaccccaaaagataaacccactaagtatttcagaagatgacttctatgactcccagatattgatacaatttcatttcattcaattagcatattgcatcatttttcataaaaaatgcccaattgtttaaccttgtatttccatgttagattcctatcataaggaagctcgcaaaaaaaatatgatttgatgaattttttttctcaattattcataacaacacacagagaatgttcccctaacattgactgtaatttgactcatttaattaaaaaacaaggaaaagaattaaaattcagtgatattatggaatagtatcgtatattgataatgcagttcaattggaatcaactgagttgttaaacaaatccctcgttgaaaatgatgtccatcagatgatcagcaaaacgaaataatatgaggtaaggttcagcaaatttaaacatatatacaaacatataataagttagaagatagtattttgcaaatgagtggaaaagaaattatgcaatatcaataaattaaggacaagaaggttatgaaaaacttgcctgtgttagcgtagttgcatctgcaataacaaatggtacattcacaaagcgggctaatgtttttgcaagtaaagtcttccctgtccgtgcagataatattacagtgcataagtagggccgaccatcaaacccagaaaatttaataaaaacaatcctcaggcacctcaataatatattaaaatttaaaacacttaattatagcaatgaggctgtacccgagccagtggggcccatcaagagcacattgcttttctctagctctacatgatcatcgattttagcctcaagattccctggatcagctgccgacctggataatagatcagcatattcagtttccaacaaaagagtagcaagcatccaagctttaccacctgaaaaatgtcagtattaaatctcgttcagtcagagatagagtatttcttaagaacaggggtggcaatttctgacccagaccccacagacccactgtaattcaccttaaataaacaagtttcaatgatgtgtttttataataaggttttgtttcaggttaaccaagaccaatctgattacaacttggtcaggcttggtttgtcagccagacccaatggatcccatggcctggacaagtccttaaacaaaccttaggcccactagaacagtagtaccggtaatctagttgaggcttaattgcatgattagggaggctatatgtttcatagttaaagagaaagaagaaaaagactgaataaaagtggagcagaccatgtctgggatttatcttgttctcttttccacttaatttcctctctctctgcatgtgtgtgcatttggattcacactcctatattccctcctttggccctatttcagttttgtttataaaggtatataattgaaaagtgaagcactaaattgtgttggtggattgcatatagccatatagatctgcacgaaaaatgagctagaatgggtttaattttttggaaccaattacaaaatgggttttgacccaacctaaatataacccacccaatgccactgctactcaagaatgaaaataaggatataacaaaccctttctgcaaggatgcatggtagattcgtttataatgattgtagacagccacagataggacctgcaacatgatggtgaattatggaaaaacgattaggacaaaatgccttagaaactttcatcgcttcaaaagcatggaacatattttccaaaacaacttagtgtttgatccaaatatccaaaaaatttaataaaaggataaaaaagacaaaggttcatacacctaaaaaattatccatataatcactgctgtaacaagaaaggaaataatccattagagaaacaaagacgtagataatcaccttcttcatgcgagagccaagaaacagaagtaaaaaagtcttgaaaattaataatgttaaaaaaaactgattgcttttcaaagtgttggagaacttctgaaaaaatactggcccatcttaaaatatcataatgcttagtcgcaaggtgtaaagattaagttttgtgacttttagcatcagtagttcaaagtaactatatactgacaaaaaaaaaaaggcaggaaaactccaaattaagcaaacttctgaaaatgtggactccatattaaaggtgaatgaaataagctatccagatttattatgagtcgaattggagctcaaattctgggctcataatattgagttctcaatcagcttgataacataacaagcataacccaagctaggatggactaatcttacatgagctttgctctttatattataagatcatagctgatgagctaagagatccaagtcatggaaagcttattacattctgacctatgcataaacaaaaggaagtaatgtttttgggtcgtactaagcacgacgctttggtattgcacatgatgtggcaccagctcaagtaaaacctgtgtcagggagctaagttaaactgaatttgagcttaaaagaaactgaacaactactgaagctgagacaggaagagactggataagattagcttagaccaagtgtgctttgaggtttcaagcctgatttgaaccaggctgagcatgagataagaaaagactgaaggagttaaagcagagccaagcccaagtcttgaggttttgacctttagaaacctaagttcaaactagctcaattgactctcatacgtacctagtggtgtttggccaaccataaggagagggaaagagggagggagggagggagagagcaatggaggctttcaaccatcgaggggtgtacacagagatgttggagtccatccccacttttcagatagagagcgggtccggcctgcttaatgggtccaggtccggttccggacctagctgtcacatcccgtctctgctaaatgtggcacaagttgagggaagctaaacttctctttaatgtagttgtatagatttccattattgcatgattaaaaaagaaaaaagacaaacttgaacttgtgttaccctctctctctttccagatgtgaatatgggacagttatcatgattcatttaggagggaaaaagaaaggatggagtgtgtgggagtgggacttgcagtgtttgaactttgaaagtccatcctaataatttaaggaaccacatttttagttgaacttccctttaatgtagttatatatagatgagatatggaaccaagaatgtgaaattgctttctcaacctaaaaaggatttgtgctttcatataagttaataccttgcagatggtaggttgtgcttgtacacttactcttcacataaatagagtaaactttctaacaccaatgtatttaggcatctattatcatctagtgaaacaaaggaaatgggaaattgtgtccatagatgccatcccaatagtagtcctatgcatatttagtcaagccctacgttaacaagtacgaaccacttagtacatctgcctataccctctgctttcattttaagaatacatactcatctatggttgattggtttcttccacgcccactaaatacctaggttcccggtgtctcactccttgaattaatttatcatttaaggttttttcagcattttcttaaagaatatatgaaaaaggaagcaagagatgcagatttgcgggggactcagatgtgcaggactgcacagtccttttaagaatacaagaatatcacattggagatctggtagtgcaattttcttaggtacagaaaagcaaaactgatgggcctaagaataacaaagaagaggagagaacgagctagaatccactacaagaaaagtaaggaaatgattgaaactcgtttgaactcataacttaatcaagattcacaaccaatttcacagacctggatcatcctggatatatcatgaaggcctttaaacggttacattagcatttcattatatttgaaaaagaatatccatcatcacattagctaagctaagaatcctgaactagctcaaacactatatcattagccaactcatgaatcttacaattcccgttggatcccaaactacaaacatggaaaccgttaatacacagaaaaaaaatggacccttaaacaaccacaccgaatgcttattgaatcccattttttctaaattctttcctttttccttcctcaggtgtttcccattgaaagaataatattagattttttttttttttttttgtcactttacttcttagattgtagataccatgtcatcagtctttcaaaaatgcaacaaaaagaaaaatgtagatcgttcaatttgaattagtactcaagctatacaggaatgttcatgtgaagccctcataagtcgggttgcatcgaaagaaagaaagaaactataccaaaaatgagaaatactttcttctgtatatttatttagaagtatcattatcaaggaaaaactattcacggatttgtctccagatcctcctaaatcatggatatccataaatgaattgcgatctaaaatgaaggggaaaacagctacctttttagcacgctgctggccaattacaaacgtatcgagccccttgcagatctccttcggcgtcggcagatccttccctaaattcgacccaccacaccactccttcccaccaaactcacccccatcgcctgaattcccgcctcccccgccctttctgtatccccccactttcaccacattcacattcggcggcccgggcggcacatgcaccgccagcccattgccccccggcgccggcgccgggagcggcataggcggccaattctccggcggctcccctccatacgtcgccttcagcgtctcccagaacgtggaccttatccgattcccgatctcctcatctccctcacctccaccgcccttttccttctcgggagtgtcccttctgacccgcccgatctcgacgaagctcccctggagggggacgagccgatgggggcggaagtagaaggcggtcctgcagttggggcatatattgacggcctggaacccgccgccgcggtcggacgtggcgggggccggcggtggcggtggtgggcggtgggagaagaggacctccatgtgcttggagcagcggggacagtgggcctccgcccggatccgcagggtctgggggggctcttcgggacctccacccccttcccacttatgccgctcctgccggtgcagctcccgccgccggccacccacggcgacgacggcgatggcccccccgcgtcgcgtgcagatcggcgaccgctgcgagagcccgtgccggggtgctgcgccgcctccggcggcggcgatgcctcgcgcggcggcgtcactcagcctcctccatcggagaatcgctgacatcttcttgaattcagagagagagagagagagagaggctagtcgcggtcgggcggagtttttatgcgggaaagcgaggatccaagagtacggtgatagatgtggtccagcgagattgtagcggtggatgatacggtgagggtaaatcgtggccgttgaatgagggcgacttcgacggggaagtggaccggggtggaaagaaggctcaacggtcaacgaagcgtgggccaagcattgttaacggcagcgagtttggtgggggtgggggagtttggtgggccgaggatgaggcgacgttgttcaaggactaaacgtgaccgtggccaagctgaagcccatgaggtgaattctttgggcaagcttgccaatgaaagactagttttgtctagcttcgtatatatagcagtttcaggttagtctttctactttggtggatggaaggtgacatttttttggaagccatgttctggtttatgccaaggcacagtttccatgtgagatggcatcatgtccaattccatctccatcagttcgaagaaattgatgtgctcagctgtttttggttggtagtcgctttcaagttttcagacaagataataaccaattttatgccctcgatattctagatccaacacacaattgaaaaaatgaagcacgtaattagcatgtggtgcatggaaagattgcctaccatgagaccgacattgtcacgaaaatttcatgttggttgtagtgtgtccagagcaatgaatattcgagtggagttttattttttgagaaaatgagaggagattattagcactaactcatgcatgcacaggatccaaacctaggtcaccaataccaacttccagtgagctagttggcatccattattgatgtggtcattagatacatcttcggatgatcactctatgcatgatacaaaataactattagattactcgagaagataggaaagaattgtaagaagagaaaatacaggaagttgtagtttgttaggcatctttagaaaaataacttttgtaagttaattttgttttagtataaattttgaaactactggcatattactcacacaatgcctgggaatttttttatttaacaaatatatcattttaaaataatatttttatttattatataattttttagacattaatatctattctattattatataaaatttttattttattgatgaatgtatttattgatttttattaaaatatcatattattaatgcactaatatattattttatcaatataaaatttaatttattaatatattattaatagatcatttttattcgccgacggagaaggtggtgagggcgtaagcaaggccagggacagtgcagaccttctaggcgagggtgctctccttaccatcaaagagctcaacggtgcggctgcgacgagggacgaagaagtgagctaagtccaggtacttgatggccttgggcagacgcctatggactcgtagtttctccgaccactgaagccctaccagaatcgcgtcgtcgtccgcggcgggctattctccaaccacaaaaccctccacccctcctccgccaccgaccccatcccggcccctgctcttgtcgacttccatgactgagaccccgattaccccctcctctgctgtggtcgtgcctcccccctcgcttgctgccaccgatcgccgcctacccccccccaatcaaaacctaagaaaaccctctgatctccgagacactctccttccccatggacctcccaaaaagaaaaaaaaatgatcaatctttgtgggaaaagatcttgcctcatttttcgaaaaaatgagtgaggagatcattaaccctaacttatgcatatgtaggatccaaaccagatcaccaaaaccaactttcggtgagctagttggcatccattattgaagtggtcattagatacatattcaaatgatcatcctgtgcatgatacaaattaaataaccattggattattccagaagataggaaagaattgtaaaaagagaaaatacagaagttgttgtttgttaggcatttttagaaaaataacttttgtaagttaattttgttgtagtctaaattatgaaactataagtacagatgtgatgtacctagtagtcgagtctacaagcaagaatgttcatatgcatagagagtccaaatgagcaagtgatccatgggcagtccacgttcgactttgatggcttcttcaattagggttccaggatgatcttgaattctcagagaaaaatataaacgtagttgagcttgagacatatagagttgctactaagaatggttaagctcaggttagatcaagtccaggtttcactaaaccagaccatgtccattgagattttggtgtttcatgtccaacttttatttcatacacaagctcgagtccaagtcaggatcggtcaaaataaagttgggtgtcaagtttgcgggttaaagtggtggcacttaaggtcgacaaataaaaaaatattttatatatatatatatatatatatatatagcgtatcaaatgagaggagtgacttaatatgaaaagtgagagaatataataataatctttatatccacatcaatggtccagatgagcactacgtgcgtattaaaaaaattaaaaaatgaaggaatggataaatcttaggggtatttggacagtttggacgatcgcattctcatttgaaccattaatatagatccaaaaattattattatatattttcacctctcacattaagccactcctctcatttgatacgctttctctctctctctctatatatatatatatattgatcattatcaaatattatgtctagaataaggctgcaaatgggtcgagttgactcatgattcgatccagtctgacccgtttagatccgatcctatccattttagaactcgtgggatcggatcgaattttaaaattggacccgttcaatattccgagtcgggtttgggtttactgaattaggatccaatctgatccgatccgatctgaattgagtattaaatccaacatgtaaactatagaacaaatagagtaggattagaatttcaaatgctcttgtagaattgttattttttatatagttctacttaatttgactatgaaattttgagaaattgcttataaattaatagctaaggcaaagtaatattttttttcctttgtcataaacttcgcatacgttggtttatcatacgaaccaagtccgatcaaaatttggatccgagctggatccaaaatttttaaattgggaccggattatatgtggatccgatccgatctaaatgatccaaaggaacaaactttttgatcatggatccgatctgatctcacccgattttcaattgggttggatctggattcaacattaggatccgatcaaggagtcggatccgatcaggatcactcattactcggtccgatctgatccatttacatctctagtcaagaataaaacatcctggccattaaaaagcaatcaagtggttgttgctcatccaccagcaagaaatgtatgtattaagagcattggggcattcaagttcttgctatcccattgagctggttgtgagcccatcctagggttttatataattcagccaagcatgagttaaacaaagatcaaatttagcttgattatgatacaagttgagtttagacatggcctagctagcttgaacgcaacccacctatgtcaaattcaatcaaatataattaaatttgtcctagttcaattgcctcatccatatataaaaacatgggactgatttttagtgctcattaaacaaaactaacttaagtcatgacaatgacaataggacttcaaaattaatggtctatcctattcattgtttcctgcatatatacaacaaacaacatcacgacatgcaaaagggtgaagtaatacataatcatgtttgtattagtgcttagctctacgtaatcaaaaaatatataaatagaaaaaatacgtttttataggtggatcatttgaatatttgcatatctcatactctccaagcatcatcttcttttcctggaagtttagacaatcaaaagatgtttttggttggtgccttgtttaacattacccatgcaactcacacgctagaaccatccccatgtatgaataaagaattttctggggatagatcatataattccattggtttagaccaccaacaaaagtcatgcaaggaagagcaagtaaacagagtctcaccgggagaagagaagaataataataatggaatatgaaagcgcggaagccttggggcacaagttctgtgtattagccccagcaaattttgtacttttttagcttgatcacaaacaacatagtaccaggatagatgataatgaaaagctacgattagatctattttgagaactagcactactgtaattcttgctacctattaatcaaaattaaaatcattgaatatattgataataaattcgatgcatatggtattcgttgcaagagctagaaaggctaatttattggcattatacaagattgaatggcatcttgaacaaaataagacaattaacgttcattgagatccgaatcaaaattggtatcagaatggccctctgaatcggaatagagatttgaattctttaagaaagagtctggattgaattttatgagattggaccatttatattctactccggaattgaaattagaatggatattttccaaccaaatagttagaatgggagtaacccattccatttctattttaggccccaattctctccaactaaacatcgaaatcgaaatataatttaaataatcgggaagagtagagaatagattttgagagattgaaaaattttctcaaaaattggaatggaaatagaactttctctaaccaacagctgaaagggaagttgctcgttctcattcccatttgagactccaactcccttcaactagatgtctttcgttcagaaaattttaacatgttcaacctgaaaggaggtatccctgaccaactcaaccaacatctgagatgcttgctgcgttggacttgccatggtccgcttaacataacccacactcctctgcaggagccaaaatcatcaggtgcagtttggaaaggcattcaagctgccatagctatcttgcaagctacctcactagagattgaattaataaagctctcaccataccatcacttgcctttattctcctggggcaattgcttcctctttgaatcctttgcttctggatgcttgtccccttctttgaggaatccaaaacttgcttttttttcccatctatgaaggaaacccaatgaattagctaatgggctctccaattttccagctacagtgaaaaattggaattttaatttcgttccagaactcatattacttgtaagcactaacgataatgttgttttcttctgaaggattgtgaataatattatttagggttctggccttgggccaaaacaggagagacaagagctcacattttaggtaaaacatacaaagttattgattcaaaaaaatatggcctgagttgaaatcaagcggagtgcgtatgggaacccaatcatggactagttcttgtcgcattgattagatcccctctgttagatgacaagaattcctcatttcgaaggttggatgatgcattctcaaaatctagtctagaataattgaagtattggcaaagatattggcatagagagagactaacccgacagatcccacaattaaaatataaattattttctaagaaacgttgatctaaatatacatgaaattatagagatgcaaatgcaaaactttaagtttcttaatacaaaaaagttaagttctattacttttgattgattttatatcttgcactgatagcagatctaatctatccaatttattacttctagcagcataaaattgatttatgatttttgaacctatgcatattggactttatgatttgccgtatccattgtcaccccaagcttctcattgtcttttattttttttatttagtttatttagtagtattgctttccctcccataaaaaataaataaataaataactaagtaaatgaagcttcgagggccattttttgtgagaaagttgaactctcctaatataaagttgcaagatgccacggtttatctacattttcacacattaatgatgaaaggaacttcgtgggatcctcatgttttaaagagaagtgaaagagagtcccaggacatatggtctctgatttctgaataggtagaaacatggatttctcacacaaaatacaattctctcacatacattttgttggaattacatggtatttcaaaaggtatgaagttcacgtcagccctatacctatttctagtttgttcttgatttttagctgatttttttgatcgtgttaactattctgttaaagatttgcttttacatgattctagccagattttcaaccactttaccaacgtcctctcacctaaatggcctaaaaatattactccacttaaccctcttgaaaaccaaccaacaaatttttcttcccaactttttctccatgacaaacagcttttattcatatatcttttcacctggttgctgtctcgttgttaaaaaaaaaaagaaaatacttcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgctgtctcgttgttaaaaaaaaaaaatcttcactttaagtttttcttgctaggtttattcttatctttatttctgttacttctgcttcctcacttatgagtgcacactattgagaaggcctgttgtatcctgagggatagccgtcaaaataccttctgcacctaagaaggatggaatctatcctttaggatagtgtttcacacctcaagcaaaaatcgtagttacaatcctaccttttgccttttcctacaatctaaaggatagaaatggatcccactactactagtaccattgccgctagttcctccaatgctacatccactgttgttgcaatgtctgccataccgttgcttcctaccatacctctcactgcacatgaggggtttccagacacctccaaaattgatgtgttttgtggcaacaactttagaagatggcaagagcgcatcctctcagctcttgacatgtacaatattgattttgctctaactcaaacaaagtctgaagaagaaacacctgactataccagcaatatagagaactggaggcatgcaaataagacgttggccaacaaagatttgcgatagagaattatgcttactggcatatgattgaagataaggatatcaagatgcagatcaacgagtaccacaagctgatagacgacttgaagtccgaaaacatagagctgtcagaaagttttatagctggcatgctgatcgaaaagctgcccaactcgtggagcgactacaagcaacaactcaagcacaagtacaaggagatgtcgttggaagatttgattgtgcacatcatcatcgaagataggaatataaagcaagtggaggctgtaaggaccaaggaggtgatctcgaaagccaacttgatgcaagacaagtcgaataagcataaaaggtatggacactctaaaactaattataaacccaaatctaataattgtaccttcaaaaagaagggatattgttttgtttgtggcaagccaaagcaccatgcacctcaatgcaggaagagagtgagacatgacaatccggttaagccaaatgcaaatttggttcaaatagatgataatgacattattgctgcggccatttttcaagtgaacatgatagcaactttgaaagattgggtggtagactctggtgccaccaggcatatctgtgcaaacagaaatgcctttatctcctacacaccagtaggggaaggagaagaaactatttacttaggtaactcaaaatctacacaagttcttggaaaaagaaaagttcttctcaagctcacctcaggcaagatattggcattgaatgaagtgctccatgttcctactataagagcaaacctattttttgtggccctactggaaaagattggggaaaaagtgtcacttgaatttgacaagatagtaatgacaaagaataattttttttgggtaagggatattctaaccagagactctttgtactttatattgttgaagtaattaatgaaaatgcatgtacttcttctgttgatatgcttaatgatgttaatttgtggcatggtagacttgggcatgttagtatatcatatattaagaaaatgcaatctttaggattaatttctgacattgataatgcttgcatgaacaagtgtggaatttatgctgaaaccaaaacaactagaaaaacttatgcatttgtggaaagagaatctaaacttttaggattaattcatactgatttaggtgatttaaaacaaactatgactagaggtggaaagagatattatatcacttttattgatgattattctaggtatactgagatttatttattgaggaataaagatgaggcctttagtatgtttctattatataaagttgaagtagaaaatcaattaagtaaaaagattaaaagagttagatcagatagaggtggggaatatattttgtttaatgatttttgtgagaaggaaggtataattcatgaggttacacctccttattcccctgaatcaaacggagtagcaaaaagaaaaaatagaacactaaaaaaaatgatgaactctatgcttgttagttcacatgcacctgataatctttggggtgaagccatcttatctatatgtcatattcaaaataggattccatataaaaacaccgataagataccttttgaattgtggaagggttatacccctaacttgaaatatttgaaattgtgggggtatcttgctaaagtgttgttacctgaacctaagaaaagaaaaataggatctaaaacttcagattgcatgtttattggatatactgatcatagtgcagcatataagtttcttgttttgaaaaatggcatgcttgagtgtaactctatagttgaaacaaagaatgcggaattctttgaaaatatattttctttaaaatctgagaaaataactcctgggctttttgaaaatgttggttttggaaactcagatttaggtttgagaaggagcaaaaaacctaaaaaaaaattatttagaaatgatttttgtatctattttattgataaagatcctgtgtctttttctgaagctatctccttccctgatagtcatttttggaaagaagctatcaaaaatgaacttgattcaatttcacataatcaaacttaagaactagttgatttacctcttggagcaaaacctattggatgtaaatgaatttaaaaaaaaattaatcctgatgattctattgataaatacaaagctagacttattaccaagggttttaatcaaaaatcaaatgtggactattttgatacttttgcaccagtgatcagaatttcttcaattcgaattttgatcgctttagcttctatttataatcttgttttttatcaaatggatgtcaaaattatttttctaaatggtgatttagaaaaaaaaattatatggttcaaccagagggttgtgttgtttctggtaatgaaaacaaaatgtgcaaattgagaaaatctttatatagtttaaaacaagctccaaaacaatgacataagaaatttgatagagttttaatggatatcagattttcttctattggagtagataaatgtgtgtacaccaagactattgataatgactgtgtgattatcaatttgtatgtggatgacatgctcatttttggaactgatctcaaaattgtgaaagaaacaaaaggttttttagcctcccaatttgacatgaaagatatgggagaagccaatatgattttaggtgttaaaatcataagagatatgaatggcttgatattgacacaagaacattatgttgagaggctacttaaaaggtttggtcattttgatgacacacctgtttgtactccttatgatgctaatactcaattaaaaaagaagagaggtgatagtgtggctcagtctcaatatgctcagattattaaaagtctgatgcatttaatgaactatacatgacctgatatagcttatgcagtgtgtagattgagcagatatactcaaaatcccaatcgtaatcattggactactttagtcagactaatgagatatttaataggtaccataaactatgatattttgtatagtagattttttactgtattagaaggatacaacgatgctaattggatctccgattcagataagacaaaattcactagtggatatgtgtttactcttggtgggggtgcaataacttgaaaatcagctaaacaaactatcattgctaaatctatcatggaatcagagtttgtagcctttgagttggctggaaatgagactgagtggttgaaaaacttcttagcagatatttcattgggtataaaaccaacaccttctgtgtctatgcattgtcactactaggctgcaatagccattgcgaaaaataaaacatataatggtaaaaataagcacattcatttaagacatgatatagtaaagcggctgcttaaggatggaattatatccatcgattatgtgaagtcagagatgaatttagccgatcctctgcctaaacctttgggcagaaaattcataaatgaaacatcgagaggaataggactaaagctgactttaagaaatcaacaatgatggtaacccaacttatgtgattggtgatcctatgaagtagattcatataggtaataacaagtcatttgttgatcaagaaaagtactataaatactattttcctttctgtggtgtgcataatgcaaactgtaattaataagaggttgagttaagctcttaatgaattctatatcccttatgagtggtgtattgaattacagtgtacacttgatggaatcacttatatatatgagtgcgaagtggggtcgcttctgtaagattctttgacaagatctctagagcactcacgaataaccaggcatgcgcatggcctattagcacaattccgcgatgagtagcaaaaattgtaggagtgtagtgtgattggtgaaacttataatttactctaagattttttttagttcataaaagttataaacttcaccaataatcctacaaattataactcattctttctaggactgattcatagctcaaaaggcaccaatttcgatgcattacactcagttgagttaacccagcatttgtttggtgatattatttgccttttgaaatatgtgggggatgttggaattacgtagtatttcaaaaggcatgaagatcaggtcagccctataactgtttctagtttattcctagttttcagctgatttttttggtcgtatttattattttgttaaagatttactttcatctgattctagtcagattttcagctattttaccaacatcctctcacctaaatggcctaaaaatactatcccacttagccctcttgaaaaccaaccagcagatttttctccccaactttttctcaacaacaaatagcttttatttatatatcttttcacctgtttgctgtctcattgtaaaaaaaaaaaaacttcacttcaaatttttcttgctgggtttattcttatctttatttctgctactcttgcttcctcacttgtgagtgcatataattgagaaggcctattgtattcttggggatagccgtcaaaataccttctgcatctaagaagaacagatctatcctttaggacagtatttcataccttaagcaaacaccgtagttacaatcctacctcttatctttttctacacatttcacgtactcaaaacttatccaacattcactcgagatttttctatccttccaaaaaaaaaatacgattctcctcagaaaaaaagtcctctatgatttgtcttctgcaccacattgcagtggcatcattgataaccatcatgtcatccatcttagacatagatggctctccttcgttaccacgacatgccttatattatggcaacaatacttcgtcatatttcaaaaacaggtaaaagctatccatctttgaaatagattttgtggtagctatcaataatgttaccgtacttaatgatgtgaaagttgcatcacagagaatccgaacacttgtcttagtccactcggctttgctgattcagctttctctgattggtccccatatgccaatcggatgaactcatcatccttgccacatgaaccatgcttcatccaacagtggccaagtggtcctgccttcatctattcccatgtcagcaagaaaagtggccaccagcggacaaccaacaaccttgacggttcacctacgttgcctccttttaagtggtcggcattcgttttaaacggtcgaaaacttgaaattgtgagttcccttaaatgcccccaaaaatagctgtttgttgttgtaggttttcttgttcccatgtacaaattccaggtttgaggggttatctcacctaattgaccaaagcttattagctttagctaagggtgatacagtctatgtgaagatggattccatggtcaattacttgtgaagaccagaaggcttaggtcaccaaactgatatgaaaacttagttgcaaatctttgaatcatattctaattgattccagtttcttcagtccaaaacaaagtgtaccccggaagcgacttagcttagctacataaagattttgaccaatggtgcgtacatcgaaagcttctgtacctataaagtacagctgaccagatggtaatataaggtcgaaaatttagatatgtttgattttgatgcaatattgaccgttgaaatatgatctgaattcaaagctttggatgctgtgattccaagtccacccatttagagttgattattgcttaaaattgcggctgtgttgtcatcatcttcattatggaattcatgagaatgttatgggaatgcataattatattcataataaaataacactatttgtgtcataactgattttcacatgcaaatatcatgaattatatatagatagctggggaagaaatgaaagaattagttttttgtttttcttttttttttttttctcttgagaaaaaggagctgccattttgtttcaaatatttgctccacgctttcaaagtttatgtggtcctcctaatcaaaaactatacaggttctgctaggtatcgggaaaaaggggttctcggaatacacccaaattgtagaacatgtattggttgcaaaatgaaattatgacatagtcatatgtaaataagctgtaatcaagaacgatattttacataaagcatgagtaaatacatgtggttaagtcataatttatgcaccaatgacaaaaaattagggttgaaaattgtgttggttgtgaaaattgcataagctagaatatgtatacaggcattttatgtgtaacttcaacattaaaattatttcacggcaattttcttagatggttatcaataattagaacctcatttttgcaatatatattgatggcaaaattacactttaatagttagatcaaagtataaaaataaaattgataacgtatcaataacctgagtttatctataccaaatgctaagaatagctcgcaacctttgctaaatcattcattactcgtaaaaatctagccttcatctattttcttgaatattagatttttttcacattcacatgttccacatcaagaaggggattgtggattctctacattcttgtctaaaccggttcctattaacatcatatacctttttcaatttactagcataaatgtggttaggcaacattcaagatgcacatacatcatcatcatgtgcacatataagagctatcaactatttaagcatgcaaaccaatgccatggttctccaaaagagattatatatatataaaaaaaaaagttttaaattttaagcttgcactgtggtcattaggtggttggactgccccactcacacggctcttagatgctaacgtgcaccaagccagcagcggcaccacctccacaaatggaactcaccatcaaatgacaaaaataatcccatattttctattaaattccaacggtccaaacagtatataaccaacgaagccccgtcgctcgctcgctctctcgctctctccgcccccaactgttcgatcatttcgatggctccgatccaattgaagcaatcgccgagttccgcgcaaaccctaacgcggggcggggcgacggaggcgagggcggtggtcagggaggcgatgcgaaccaccgccgctgcaacggtcgctgcgccgcctgtcgtgccttctctgcctccgcctccggcggatcagatcttgacggaggtgaggtttgggccggccgtggatgggctcgcggtgaatgccgcagcggcctcgtcgaggatcttgtgctgcgaggagatcgatgggcggaggtggaattatgtggtggatgtggaagggaccgggagcgtccggaggtgttcgtcggccgtgaaggcggtttcgttgcagacaccggtggcgcctgtggaggtgagttggtttttattagctttggagttgtctaatatcaaaaaaattatcattgtttttgtttcaatacttggtcttttaacttttatgcccataatcttaatcgctacttagttaattttaattcatattaagaagatatctcgaaagctatggttttttaggtggcattaatcttaactgatgttcttctggcaattacttcaatagattatgtcaatgtcttttttcttttttttttttgaaaattaatattttttgctgcttactaggtaatcctggctcttccttctcgaaatttattttttgtatcacattattttctgttggaaaattagaaagaaagaaaaagttcctgtttcattctttttttacgacaaactttgcaaccgttttgttcttactgatctggacaaaaagcttttgagtttttgttttataaaggagccgtgcgtgcaatctcaaaatggatgttggattcagaatgaaagattcttcaatttttgagtaagttttgtgtggcccttagttgcatgcttggtgcgttagataaatgcctgagaacaaagaatacagcaaagtactgaagacattgctaatgaaaactaggggattggctgcagatgaagaatttcatgggaatatttaactgataggccaaacattaatgagtttgataatgcataatatattaaaaaaataaagtgaagtgtcaacagattttggatgatatttgtcaaaagaatttgccaggggatttagtttagtcttcactgctgcgttattttgcatatggccagaactgagacacaaaggaaagagtgaaaaatcaaatttaagcatgaatccctcctgcgtgctctatttttgcctgcctcttttcagtacatgtaacaaattttgagatctagtaatatttgtcatactgccttgagttttatcattctcatcccaaaatgactgtctggaaagggcatattaattataaagtagctattggtaccaggactttgaaatatatcattttttgataggatgctttttggatgggcagtttacatctctaagaactttacacctttcatttctctactctgcattttcatgtagtacgcttgtaactgcatctagcaaaagtatggaacacatgtttttggttttctatttcttggcaatttaagaatggagacctacagcattcagctacaatataatcacagataggaattctggtgcaggaattgatctcattcataagatcttatgtagtgcctgaagggtttccagatagtgttaccccttcatacgttccatacatgacatggcgagctttgaaggtatttacttgaaccagcacttggcttcaattcataagctatttagttatttcaatctgttaatgcatgcttgtgctacaacctctaacaagaaatttttctttattttgaactctctcatgatatactaataattattatcattgttcagcatttctttggtggagctatgggtgttttcacaacacagacactgttgagttctgttggagtatctagaaatagagccacaccaggtgctgttgctattaattggatacttaaggtaaagaatatcagcatgtcctagcagggaaaacactgactataatgttatgtttcattcataaagtaacttctgcattctcttgtagaaaaccattaagttcatcttttacttgctctatttttctagtagaatcactactattgtctatatcagcaagctaaggtgctgctatgctacatatattgcttatcaaaaaagaaaaaaaaataatctagtgtacatgcaacgacagaaagacaaggatcttgtatttgaagtctttcacaatttgttagtgctatacagacacacagatgcacatacacacctgtaaggacgcatagctctattacaactgaagggagctagttttcaacttgtttagtcttgtgagagcaaatttctattaatttgtctatttttttttttagtttcattaatttaacaatttaatgcatattttacgtcacctactggacccaaattgttaaataagcatcaaggggtcactgtttaaagaaaaaatgattcaaactagagattctgtttctttctaaaattcagatattggacatttatctgttattgactgagactgaccaatctttagatgttcgttttccatattggctttaatggctgatgaaactgtcttggattacctgtggaactgttcaatggtccactagcttggggcttaggacttctgacaagctgtatccctgaattagattgataaatattccaaagtggtggatgcagtgtatggtccaccaactgctctttaagttagtagaaggtcatgcattccatgcacgggttaagtgggatccatgtgttatgtgcaattctgcatctaggatgctataagctcatcctcaatatgagtttgctagaaaacaaaatattttgtcgctaacatagaaatcaggactgaagtgttgctccaaccaagatgtttgtgtatgtcaaaagatatgcatgtaagtttttgtagagtctagatatctgactgaacaacctaatttccaagtaagtttggtttagatgtaaggtccaagatacccttggatcaaggctgggtaggtctcaatcaaaagttttccaatcacaaattggcttccagttaggcatccaacacaactaggaagacacagtacaaaacttgagaacttgagaatttaacaactgcaacatctctaaatcagcaggtagtttgtctcagaattgtaagttgttcatggtgaccgacttaaaaacaagattcattgatttgtggaacaaaggaggatggagaaaaaggagagagatcattgccttatttcaaattttgaagaaaaatgcctgaataaagtagtattcttcacctttatcttggagaaggttgcttaagaatcgccttaggaatcccatgtctttggatcttacattcaaagaggtaccaacttgatatttaacaaatattccatataaatgttcattgttggactatggcagaggcagttcataaatgtcttggacagtaagcatccatcatccatggatattggtttttagaactggactggactggccagtcaaaccagtagattgacaagctggctcttgatgcactttgggcttaagtttgaacttcggatcatgaaaatcaggtgatctggctggatttttgctcagctcaactgacttgattgagttataatgacctaaatttcccttcctctttctttaaaaaagcccaaaaaaccataacaaatggagacttgaacatccaacctgctgtaaatgttggaagctccttcaccagcacaacccagaatctgccttgacatataatgatgataatatatgatacatatattataaaatagtaaattagaaagattcaccacatgacacaaaatttcattaagccaaacaatagcacttagccctgatattttaataattaatatttggcccttggttttaccattgaatgtctggatcacaaagggttacgttttatgaacatttttctttgaaagcttcctgagcattatttttactaaattttagcagtccgatgcacatgcatgcatgtagatgactctgatttttaagaaaaaataaattttagaaagcacattcaatttttaaaatatttctttaaaaataatatatttataatactattttgcccatgaacctatctagtcttagatgattatttttaattgaaaagtgctttggatatgtgaaaattctaaataaagaaagaaagtcaaaaagatgtcaaggaaataagacttttcttttcctgcgggttgtgggtcctgggtgcccataaggaagaaaggtagagagcactttatttcagggcacaagggaaagaaaagagatcgagtattataattttattatactttttgagaagtgtaatgtatggctgcaggctttgcggctggccttaaggattttttccattatatagtagatttttatagtattttatcatatatttttattggatcaccaattgaaccaatgattgattggttggactggtaaccaaggacttgttcttcttgctcgtttgatatccagtctgggcttgataaatgttaactattgacatgtaggctagggctcatgaaccaaaatcatatcacgtagctggcacatgactgcccattggttatgttctcattcttttgagagtgttaagactcactcctacatgcacatccttgcaagttacttgggatactggttgataatgatgtttgcatgtgtgtcttgattatcatgtgcaagagcctgtgaactatacatgcatgcaagtgctgcttgcagttatgtttgcttgctccccctgctacttgctcctgcactgcagatgagctgctttgtctgcttacacatgcatgtgttggtgtgcttggagcactttttaaagttcattctgactctgagtgtcaaatttactcctgcaactaagaataaaaaatcattggttgcaatcgtgaagaaatattttactagaaactataattcacaatgtgtaacacatccgttgggagtcataagatgtaggagagccccacatatgctctatggggtaaggttgatggaaggctgtcagaataaatgcatgtaatgtctggatacctaataacaaagaaaacatgaagatatggagatgaacaaatactctctggagttttgtctgatagtaaagtagatgaatccttctagtagttgtcaccttgaagttacaaagtattgcaagccatcaatgataaaaaaattatgttaattaatttattgttaatgatatttttcttttttcatggctacagaatttaattttctttttcactttaaatttaaattttgttccagtatagctattcatagtttcaaatggtattgagataatcaggtttcatggtttgcaaaaatctttggctctaaaatgccacatcaggacacattctggttgcttaacttattatgcttttaatcttttattgttgccattatattttttttgttttgttttaagttgttgccattgattttcaagtatcagcggccaaattctgtggtttcttatgattctgaccgtgcatggaaaatatgcaggatggagctgggcgtgttggcaaaatgctttttgcacggcaaggaaagaagtttgactatgatctaaagcaggtaaagcacaagcacatattaatctctctacacctctattcatagaagaacgttattcttaaatcttgttgttgattggcccagcttcgctttgcgggtgatcttttaatggaattgggtgctggggtagaattagcaacttctgctgttccacagcttttcttaccattggcttgtgcagccaatgtggcaaaggttgaacttgttcttacacaatcagatcttttccattgaagttatatgaatggaggttattcatgaagcatatctcttgacaatctccccatgcagaacgttgctgctgtgacttcgacatcaacacgcactccaatctacaaggcctatgcaaaaggagaaaatattggtgatgtcactgctaaaggagaatgtgttggcaatattgcagatctggtatgctatcctgctttctgcctacatattgttgctttaaagtattaatcattagtatattaaatgtctaggagtatgaaagggtttacaagacctgatccgagtaaatattttggcaatattacttatgtgacagctaatctcggacctgctttgtattccaaaattacaaatagcaatttaaatttaacatgaccctagagtcataaaaggatattataagatttctatggtatttttttcattggtaaaacgtttggtcaacagatgccatccaatgaaacaatattaggcacaaccagtggagagtcagaacttgaagggcctctttggctacaactgcaggcataggttgggattggacagctggaactgggtgaagggagggagggagaaggagaggaagaagggagagcatggggtgttgggcaggctcctcccactctcccagtccctcccttccttccctgttgttttctttctccagctgatcttgccagatccagcaggaagttcccagagaggccctaatacttttgcagtgcagcagtaactatctccctttcctatatattggacttctaggaaacacataatcacattgctgtctttcaaaatgtgcatattctcttcctccaacacactgcaagctccatatttcgagctctctctttcttaagatgctattgtcaagcacaaagtccttccagctttgatatgccataacaactccatttcaaaagcagactgacctttcatcggataattagcacttttgcttcttcaaaatcaacatctttatagtaccaataaaggactccagattcataaggaggtctcataggtgaagccccataatgccagtcatctctaaagccctttagcatccacgatagagtgtgagaggtccctgacagagattcctcgaaaactgatcatcctttcatgtgcatttgatgaattcatcccacatttccagatattgttgaccattttttcttccacaagattctcagaataaagcaaataaacaaagtacaaactattgcttgactctgaggaatgccatgttaggcaaggtctgaactccatcggagatcacaatattcagcctctgagcttcaccagagaacaaactgtttaggtttatatagattggatgaaaaccatgtgaattaagattttattccttgccataaatggtgcaaaacgcagcatcaactaggatacatagaggaggttagaggtcttttaactgtaaaatgatgacttccgtagatttcacacaagttttgaaaagtgcaacatagtgagttacagatttgcaaggcttgaataagaagaatgttgcctcctatgctttaatgatttcaatttatgtttgttctgcataacaagccaacaaggccctaaaaatttatataggagccacagattgcacatattgctctagaggaacattaacagatattctgagaaaagttttagctaaagttctgaatactttgttgaacaaaaccagcttatctaacttgtttctagggttaaaattcttgcttatgagattagcttaatttatagatgttcatataagtagagggctgtatgggtgaattccattagtttgtaatgataaagaattggccattgaccaaaaacatagagatctgatttggtttctttgttggggttatagcataactccataatgttgcccaagttgtcttttaaaccgatttccacaatattgttcataaactttagataacttctaaaatcaattttctttcatacatttgtttattgcatttatatgtatcttgttataattctaatcacaatttcatcttgaacttcttgtcttgaagttggggactggaatgagtatcttgatttcaaaaagaaacccatccttgcttgcttcatttgctttcctgtcatgtggatatatccttagttcatatcaggaggtatgggtctttaattctatgattaaattctgtatttttgttattatttgttaatgttctgacagaatcttctgttcaattaatatttactttgtcaggtcaagtcagttgttttgaacactctaaatagggcaagattcaccgtggcggtggaatctttcattaagactggtaggtcaagtcagtcttctgatatgcatattgactctatcgagctgtagtgagcatattgtagtgtagtggttctagctggtgggatgctaattggtatagtcccacattgtgagcctcaagatataggttgttcttgccataccaaaagtcaaaacatgtcttttgatatggcatggtacaacacaatacttaatattctgctctagcaatggctgttttaccaaggtggctgtacgagcaatgatagatatgttttggatggacccagaagagctatttttgatggtttaattatgaatgatagaaatgattggaaaatacatgtacagcaaaattaaagaaatacaaaaaccaatattatcttcaatatgcatgtttgtgtaacttatacttgaaaatacattatagcaacagctttagtttatcagcataaggggagaaaggtttatggtactaataaaacatgaagctgcaaagcacatggtgctataagataaagacatgtattaagacacagtttcatagcatgattatcctaaaaaattcatcaaatgaaatgtacacaatacaatgaaaggataagaagttattatgtaacatagtgccaaactgaatgtctataacggtcacacatggttgttacagagtccctgacatccatgatatatatgactagtaaatcaggttttagtggcttgtttctttcttggttgtaaacttaaaattgttggccttattgactcaatttaattttgagtggtaatggaaaaaatatggggagaaaaagagcagttttgaaggctgacaaacaaatttagtttcaggtatcttgatactaggattgtcaaatcacgatttatttacacatcatggcatgctgctgtaatgagttatatttctctttgtattgattgataaaatttgatatgttgatccaagatacaatagggcatgtagcatattagagaaacagcagataacggcttgtgtgacatgatattaaatgataattggaatttggtcaaccatagacttgcttacaagaaataccatttattcctaaaatgccttgatgtgtgagcatttaagttcatcatatttcagcacattgcattccttcccaacttatgttgaaactgggatctctacttgaagtgggttttgccaaaatcctgtgtataggatgttaaaacaccaatatttctgttaaaacaccaaaatcctctatatatagaacttggaacctctccttgtgcatgccttcaggaaggggtgccaaccagcttctctatgtgatacctattattttgtgttctaaaatcatctcaaacttctctatactagataaatttgatttgacatatgccactgctaattgttcaatccttataattttgcagggcaagttccctcactgaaggaagggaattcaaaggaaaatatattcagtcctccatggttaaaacatacacctgtcattctaggttgacatgatatcccaatcattttgtttttaatttttttatgtgagtaattttgcacagctgcagaaggctaaacttataggtctggtttgagtctcttcaggtcctacatttggggatgcatttcaggatcctgcttcatttcttgccacgcagtgcttgtttgaggtataatttccaaccttgtttacatggtggtttttggatgcacttgtagtttgcttacttctattattctgtatattgtgcaacttacattactgaacattgtcatccttgaaataactttttcttttccccttaccatgctgcattaggtgtgagctgaaatattcttgcatatttgctaatataatttatctcccgttacagaaagaaagatatatggtcacctataacccttcaaaggataaaatttatgcattgcttaaggatcaagcaaagtctgatgatattttgaaagcagctttccatgtgagtatggattcttaattttaagtaatttaggacatatctgctttaacctcttctaattcagattaatgtatcttgtattacaggctcatgttctattatattttgttcgtttatcaaatgtcaatcgatctctgagaaaccgcaataagtacgatcaatcaaaactagaatccccaattcctacaaactctgactttgtggctcatgttgcggagtcctgcaagattgtttcatcttcatatggggttttcaagaggaaggcagcagaacaggtgacatgttggctacttggctatcagaagctttagatgcatgttaacattaagggccattaaacatactctgagatgtgtttaaacacacacacacacacagaaacacatacatatatatgcaagtacgtagtaaaaaatagatcacaattagagttattgcttatgtataatcactgtttactatcataaactcactggatttgttaattcagttatttgcctgggacttatacgtgacttagatgattttgtaagttttaacattcatgtcagttaaaatcaaatgaagtaaacttagaagtccggaagaggaaattaaatccattatccaaacagaaaaaaggatattgttaaagaaatagtaacaaaatatttccagtattttattggaaaagactgccatggttttataaattttgacctttggctgggcaagtgcctttcatcttatagatggttagcgtatgtggttttctcattttgatgtctcgggaaatgtggaagctattagaaaagctggtggttaggtggatctagcctgtagtaataggataaatgaggctatgaaagttcagatatctgatatatggtggatgatgtgtcatgcaagtttgcatctattagcgagaggaaagatgaccagcaagtatatccatgtgtgatgaggaatataaaacagctgtacagagtcattctgcatattataacaccaacatgcatggctaagaaactcacaggcagggtgcctgtgttgcttaaccttttaatttagtgcagctgcttctcattcctctggattgacctctctatgactgacatttttttttcctggttggtgaagagaactggcttttattattatgctcacaaccggctcctttcttgcagggatggataatgtcagactcattgcttaaccctggacgagctcggctttgtgaacttaaagagcaataattttctgaccatctcagttcataatatttatgagacctcatttcttggtctgttgattttagaatatgcagttgagaccgaatggcaaatatggttattccatgttatttcatactgtaaaccagcactcattactcagacagcagatatggcttctccaaaattattcctaaagttcacaccatactgcaacactctagtcttccaagattttactcattagactttgttgatctatcccatcatgaaatggctgcagttttttttttggttagcttcaactgacccttcctacaagcaatgaagcatgatttactgactaccagtttgtacaataagtttctagagttaaccagttggcacagtcaatggagagtactgcttgtaagcctttttctcctgacattgtaggccttttcttgtagattagtttttttgtattttgtccatctcaatgggtttttttgtctatttatctttcaggaaaaaattgactgggtgcagggcaatgtaaaatagttggcgaaagctaaatggaagagcaaatagagctttcccggtggcatgaatgtattacataggcaggctgtgacttttctcttcgttttcttttttccttttcctttttttcattcaatctgtatcatacttcaacttatattcagttatttgtaagtgggcttcattaatagaatacaatgtttggcttcctgatatttacattttttttccttaaaaaaatttggttgcagacttttttggcccttgttataatttaatgatttcacttcttgatgtaaaagcatctttttactctagaaagcagagttattcattgatttgtcaaaattatccatcatgttcatatcattgatgtgcaaatagagactaattaattgagatctctaaaagagaatgtgaagtttcaaaattctaacattcagctttctgtgtaaagttcttcgatctgtatactagtgaaaagaaaagttccaagttttccccaaaacctccccattgagattcatgttgaaatgttcatatccttcatacccatcaaatgacagcacattgttatccctcttgacatcagaaatgcagcaacctaggacttatcttctggcatgtggaacctagggctggtcattcctccctcactactttttgctttggagcttagcctcggcctagttgatcagttgcaaggggttaacccctggttagattaggaagctccaatgtggagatgggactcttcaggtcatcttctttgggagtctcttaggcctgcttgcttccaccatttgacatggcatgttcacttgtttctcaggaaggaaaaattgcataccaggaaaatcttggcaaggaaaggctgaagcctgcctaggggtcatattttctacctagctatttgaagagaagataaagcatatgctctcctgcaaagttgcccaggaatgggaacctttcttcggaactcgaagtctaatcttgtcattaaacaaggattttatgtttgtaccattaaaacacaaggatttatgtaagaccaattagagatgcctacaatgcgcgaaggaacctaaggatgcgaaaggttgagggctatcttggtgttgccacttataatttagaaggcttaaaacttactaattagaaattcatgaaacaagcattagctttgtggctagaccccatcatttcaaagcaagggttcgggtgtttgagtcttgtgctgttatcccctaacgattcgattctactagggtttcctgcagtaaaatcctgggtttttatttgatctcggatagacccagatacttgcttttctcttacacatgcgacttccctcccctatctcaaaaaataaaaataaaaataaaaattatccgatttccttaccatgttatggagtcttgaaaattgattggtctttcaataatcgaacaatttctttactttaattatggtttgatagaatgggttctaaaccatcacactttggatatagctgataaaacaagaagatatgcagatgattttgagacattgcctgatgctaatggattaggatattttgtttcaagagaacctggatccttcggttcggttcgggaaaagctgcttcatgttcttgccagattctctatcagtcacatatgtcaagttttgtcagcataagctagcgtgtggagtacccaacaagcatatcatttgatatgtttcgagtgtttttgtactgagggtcaagtagaattttgaatataacatttacgagggaatctaaggtggatttcttggatgttcaaagaggcaaaaaaaacaaaaaagtataattccaggaaaatgcaagttattcaattggttatgttatcaccggaagatccctgcggtcgacactttagcaaaaaaaaatttccacgattttagccgatgccaattctgttacagcaattgtgaagttttggatcactatgttgcattgcagctactcgacagaagtttggaagaatatcttatggagatacaatattacagatcttccatgagatataaaaactttctgggatgaatggagacaacgacagaggatctcaaataaatttagatgattggatatcattatatcaatcactctatagttcctatgatcagagagaaataataggctattccgttcaacagctcgctcacccagcgaattagcaagaaccgcggtcttcctagcagcagactggatcaaaaactcatatacagtaactcacaaactgtagttttagagctcaatcctgaggcgatatatatgcctttgatcctttttgaagactctggaaaagatacacatcttgagccgggatctactgggctgctctaccctcaaaaaaattttgaaaatagttttgcttttctaccgttgctggacactcagtgaactccggaatcaaaatatttcgaaatacctctcccaccttttcaaaaaccaactcactgaacattacttctgatgggacaaaaagtttggaatcagcccttagtatatttttttttgttcctccacccaccgtcattgggatttctccatgcattttgttctccatttgacccatctaaacattcacaagtcatgtagtgaccataatacctccacaggttgtaattcacattgatataatactaattgcaagggagaaccactcacttcctccttatgttacctcaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccttatgttacctcaaaaaaaaaagtataattccatcaagatgtggactccctacatgtcctcttttcagctctcaaccattcctgtgttctgtcggtcttccattggcaatggctggaaaatattactagctatgatgaactaaattgttcccttatgacagtttaccatctggtccagatgacttccatttctttcatagtttcctccttttattgtgatggaagtgctctcgtcattttctatctggcattttacgattgttccccattttccccataaaagagggaagaaagagatggcaaaaacgtgaacatgctttcagaaaatagcaccaacgacagcagaaacagtttcttgtcaaaataagatcgaccatgaagaaagactaaagttgggagactctagaaaagatggttcattacatgtggccaaacctgactggttttaagaattcataacatacatggaagggaaatatggttgatacttgacagagacaaaataaatctcatatttgaattgaaatgtggacaattaatttatgagagagaaaattcccaattattcttgagaaagaatactacatgaagtggttcagtgtttaacaagctgtgagctctctgttacagtgaaataccaaacatatttagttttggtgcactatgtgtgagttctgttggtatttttcactcagtatccacacaatcagaacatcttcctcccctctattaaaccttccagcacaattcatcacataatagatatagctgcacagcccatcactggcagttaggaacaagtaaagatcatggaaacatcaattaatacttgctcttacctttgaatccaagtctgatttctatctattgacaccttccaaggtgaagaactgcatttgcggtcaagaggttggttaagaggttggatggatcggatggctgagttgactctgcgtctgtgtacgtaagatattgcccgttttgactcgatcatctttgggattcagtgagcatctttgggattcagtgagcctcacggttttgtcctttaaaaaacatctcatgtgagagagaagattccaatccatgtaagtcatactccctcttgactcacaaccgatgtgggactaaagataccggcctcccgcaatattactctcctcccccccaaatcaagggagagtatatgtgcatgggtaggaggcaatcccacagacggcaccaaagttatggtttgcgaccccccctcccgtcaagggggagtatgtgtgcataggtagaaggcaatcccatggacggcaccaaggttgcggtttgcaaggatcggatggttgggttgactccgcacccgcatacatgagatattatccgctttggttctgactatcttagaacttcagtgggtcttggccatttgaagcctcatgattttactctttaaaagacgtctcatgtaggagagaaggtttcaatccatataagctatatttcctatttactcacaatcgatgtgggactaaagatgctgtcctcgtacaatagtatattcttcatgccttggactataaattaataaaatgtgatgcaattccaaaactgggcaaacacctctcatgtgcagaaagccttcaacttagcttgctctccacataacagtggtaagtaatagcagtgcttctaccaaccataataacatcaatcggatggtcttgttggatcctgtgttctccacccattgtccctgaatgctatcagaagcaggccctacctcttgtccaactctggggtggtctttgatgggtgtccatcactggcgtaggctgctacaatgaggctttcacggtaggctgttctttgtgagacatgcagtacttaatgcattcaagatattattgtttaccaaacatggatatggtctgtgcaagatccaagtagtgggcctcacatctcacaagccaaccatatgtttaggttagtacactggcaagtgggctctacatattgattgtttctactatgtgaagactctggcttgtagcaccttcagaacaaaagacagtcttgccttttaagtatttttgagttcagtgggaaaagagaatgataatatttacataaatgtacttgcatacagatatcatatgaatctctctctcccttacacactttactaagtctctctctttttttttcctttttttttcccggagactgaaccatttcctttcaaaatcaaacccttgctacctaccatggaggttaagcctcccgcttcaaatcaagggcaccccatttccttgtgtttttatgttctaattccttctggtagctgctatttggtctcatagtattgaggctaaaattcatatttctctgttaatggttagtttcaattaacttgattccattcttttcagattccaacattttgttaattcatccacttctgattttgaactttttgagagctgtgagctattactgtttttggttgctgtaagagaaggctgaagaaatagagcaatataagatgacaaggcgaggaaaaaaaaaagaacttggaatattctactgaaactaaatatttttgtgaggagctacttagattaaaagaattggatgtttttattaaaaatgttgtatgcaaccaaatcccaagcattacaaaaccaacttgtaatttaaaaagcatgttcactcaagagatatcatgattttgtggttcatctgaaggaattgttctggtaattgggtaaaccattaccgacgaagcactgttaccattttaagataaagatggagttctttggagtaaattctttgacactacttccatttagattttcttatgtctttgtttcctaatccatcaacacaagtccagatccctttctttacaatgccttatctgttttcatgatgcatgcctacactatgtcagcctgctagtttctagcaagatgactctaatcaaacatttgtcttgcacagaatgacttgtttatgcacacccaaattcccatttggttccattacatgtacatcagcagggccatagaggaccaaacccagcttcttttcaacattcctcaagtttagcagacatatccatggtgacccacaggttccgatatgccgtgctggcgaaatgcatgcaacgtacgacacgtaatttcttacaaaatgttgatgttctcagtttctcaccattattaagaatcataatcatggtggtccaaagcttggatccaacaggataatatagcatcataataactaataagagagcccaatcatatgaaattagcataagacttggctttgcttcccgttaattacttcatcttcgtcacaccataatgaagaaaataaaagaagatatgaaagtaacacacatgtcagagtttaataattgctaaagaaaagatggcggtcttcgtcgctagcaatgacatggtggtaactatgcattggatgataagagtatactggagcctaagatgtgctagtccaattgcatctaatgcaatatttagcgagagagagaggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagggaggggggggggggggtggagataaactatacattacatttactcctaaacatgaatcatctctatcattttaagaagctctctcaatctgaaaacccattaatctctctcccagtttgactatttgagtattattttttcccattatcaaagaaaaaacaagcagttctgttatgcggaagaatcaacaggagagcatgataatcatatctctattctctgtatatgctaatgtataatctgaacatgacaggttatgaatgtgaaatatattcctaccgagccctttggaggaattccgtttaaggtgtattcttccttccctagttgatatattctttcttccattcaagatgtagaatatattggattctctagttcatataacactttttttcggtctgtatcaagagaagagaatttctaactaaaattttaactaaggatttctaagtaaaattttaagtactaacaaattagaacaaccaatggaagtgatggaataactaatacaaaaattagatatgtatgttgtatagggtgcatttactatctcataaattcattatatcaggagatttgatattggtatcacactctgtagcaaagtttttaataaagaaaaagcttcataatttctcagcatttgatcatttaggaagagtcttggagaacctaggaaattttggagagattgtctttgtgtatttctaagaactaaaaaaaaactagtgcctccattcatggaatatatgaattggaggggttacagtaatgaccattaccaaccttggcattaacaatattttgagaaaaaggaactggtgctgaaaatataagaaaaacaaactagctcttactaatgaaatttgagtaaagaaagagaagaaaaataggaactgacaaacttgaaatgaaactgaagcctaaccttcagtagaatttgaaagagcatcaccacaacatgaagataaagtggagaatgaacagccattggaggactgtcctcctttctttaagtacagagtccatggaaaagaaaaacgcattgcctaaaccacttatgaaagtggtaagagtatccatatctcagacctactaaactctctagcccagatcaacaagccaatcagagcaaagaaactaagaaaatgcaccaaagctaacacaaacaaagatgaatgtcatacgcctaccatctaatctcacctctctaatccgcaataacaaatataaactcctttttgacccacagagagtaaagagagagttgggactggaatgaaatctttggtcactcaagctgggggcagctctttctttgccaagttgtgcttgttgttgtgcatccaaactctgagaacttttctattcaccccaatctcttggcagaactgctccaccacactctcctcctgcctctggagcctccacccaatcctctcagcaaagctcagcatcttctccttctgttctggagcaaatttggtcctgaccctcttcttccccatggggggtgctcttgcccctcccactccatccatctcatctgactctgaggccatgagagcacccaaaggcatgaccatttggtgtggcaatggacttgggatgagacagtggtttgctgggtggttgtagccaaaggcctcaggccctgagatgaggacgcccttgtagcccacaaattttgtttccttgaggtgatggtggtggcactcaccttcaatctcttttctgtggaagttcctgtggcagctgcaggctgagcacttgagggcctccagggtgccctcttcaccactgggcatgaactcaccacacccatcagtggcattaccaccaatggacgctgcatggttcttgaggcattccctatacatcaccactgcccctcctttcttagtgctgtgggttgtgggctgctgagcctctgtggggtttgtggagagaggaggaagaggaggaggaccatatgatgatgagtagaaggagggagtgtcctttgagaggttttggccatgagcaccagcatatttgctagttattggacttgggacccctccatgaccataaagatccattctctccatctccgtgctaatttctttttctttttctttttcttttttctttttttgtttttttttaacttcttgagatgtggagaccagaacaaactgaaagcagatatggaattttttgggtctgaaatccttgggattgtaaatcaagggaagaaaaaagaaaatgaacccacttgctaatttttatttcaatagaaaggcagtagaaaattggaatttgggacagtggagatcctgaagaaccttgtgtggattctcaattcaattttttaagtaaagtcaaagagttgtagatgaactaaagtagattcttgaatttgatctcagatacctgggactaccaggttagagagacatgagaatatgagagcaattctacaaacacacacacacacacacagagagagagagagagaacactgcaagtatttagcagcaggaagctgtgcagataacagttcagttttgagctataactgaaaccagccaattctctgggtcagaaaacctctctcaaggaaagaacaagaaaagaagcaagcagaaatagtaattagaaggtgctgtggaatatattagattaagaagcatgaaggttcccatggacttttttattcatattatagaccaacttttgacatgtactctgaggaatgataacaagatacttaatcaaaagaagagacaattgaacagtttcctgtggggaggtgggagacaggtcctaaacttttccagtcaagagaagaattacaataacaacataaagaactgtctcaaaggttctcttctagacttgaattacccatttcattctccaaatgacagcatggtgaatctaggcaaaaaaaaaaaaaagaacagaacccttctcaagagtaactgagagagaagactagaagagatttatgagaaaaactgcatggtaagcctgaagtaagagctcttctttctttcacaagcaaagagaggatgaagaaaattgcatggggctttcctatgggtatttccaatatgacttacaggtgataacccactgctgctactctagagaaggctgcactatatcttccaactttggattccatgaaaagaagactttagaagagttgacagggaaagaggggaataaacaaagaatatattaagaggtggaatgaaattaggatacatatataatggaggtggttttggtaccaagacactaaataaggggctcctagctgcagtaaataacagagctatagaggttgggaaatacagagaagattttctttcttaaaagagtggatgtttgctttgcttgcactaccaggcaccaagcctacgccagacagtaggagagagaacagtagtgtctgagaggaagagaacacacgcgcaaagagggtccccacaatatagttttgaagtaaaagtgatacaactaccataatgccttcacctatacaataaatgaaaccagacttgtatcattttggtgtagaccaaattacgcacatcaaaattactataatagctccagactattacagcaaacaaatcacactatagagtaattctctaattcaacaaaactacaggtaattgtatttggtattacaatggatatttaatcttgtttgcgacagattcagttacatagatactcaaacttgttaaatttataacttgaaaaagaaaagccacaatgaaataagagatgacttgccatcattttcccccaaaagaaaaaaaaaaaaaggagattatggtagaagttgttatggatcatcgtaatgcttataattttatgaataaaaagccttagaaaagatggaatttgaaattatatatgaacttctcttcaaaattatggtatgaacaatgtaatacttattgttagccattataccaatatataacaaataacataattgagttaaagatatagatgctgcaataacaataaatttaaatataataacatactgttgaaaatgctcgtgtcttttaaacccccaataagaattctacaaacttctattttggggttaattgaggcaatcatattttacagagtaacataacttcaattttcacttcttttgtctttaattaattgttcgatagaaaaaaaaaatttaaataaaaggatgtgtatgccaattaaatttgaaataagggggttaatttcaagattcaaagatatgtgggtcgcaaccttaaatcatcatattctcttttttttaatcactaataattagggtttggattattcattgatctaactattccatcattcaagaacctgctgggtagttgaataaggttaattattatgatatgaaaagaatcatttactattaaggttaattattcttctgacaaaatagtagttaaatagttggatcataaatatttgattgcacgataataatggtgatgcacatactacgacgattcctatgccaatctacaaatattttttctaagcttttatgctaaaatcaccaatcaagtcgtgcaagacgatcttggcttgtggagtaggctgaattctcttgttattagttactattgtgctgactcatccatgtgatcctgtattgaccttctattgggtttaattgctttgtcttctctcagaatctgcatgacaaggatactaccaatgtgcagacatggaatgttaggaaagaagcttggagacaaggtctgaaaatggaggaagagtctgtatcacggtactgtgaagaaattattaaacagtcttgggggtgtttggttcttaactaaaatcggaatgaaaatgaaaatcagaatggtttggaatcaaaatcggaatgactaaatcttccgaagtgtttagttcgtgaccggaatcgaaattggaatcgaaatcagaattcgaatgaaaatttgaatctatagagaatagtaggaattgagttctatatagattgagccattcccattctatcctggaatcggaattggaatgggactctttccaaccaaacggttcgaatggaagtcatccattccgattttgattccagacttccactccacccaaacaaacactcctatagaagacataataaacaactctggttgtttttgaaccttatcctctctgtagtctttgtttatgaagccccgaactttgtatacttttgtaacttcaatttcctataatttttgaagtttccctgactgtgtcgagaaagatttgctttactctgtaaatatctccctataattactttcttttaataaatctgggtggcaatccttgcttcccttttccttaaaaataaaaaagttgtgtaagaccataattcagcatatgtttcattattttttatagtccaagaagtcagattgaattatatattccattaatttgaagtaaagaatcggtagacgagggcaaccaacaaaagttaccaacacccaaattcaaacaaagcatgccatgcaagctggttcaagacttgcaaaaggccttgtcatgctatgattcagctcactctacactcatcaaactctggttattactttttctttctttcttcatggtaatgaaacaggaaggttccattatcttgcaatacaatcctctaccatcttgcaacttatggcatggatatcgccatgtctcctcattatgcccattagaccatgagctgccatgatatcattttaacccaatttgagaccatactttccaagtagtgggtcttctttcatggttccaactatggcatgcaatgagtgtgatggccaaggatctttcaacatagtaaaaaggcaactaagatatatcagaaagattttgtgtactcaaaacacaggctagaactccgaaccaagcaatgtttgtcctttcaaggaataatttgctcatagtttggaatatagatggctgtaatgtagatgatccgaaaagctagttttatgaaggcctcacaaaatgttggatattccaaaaatatgataaacttgatgacaatcaagctcaacacaactggattctaggagcatgccaattttgagctgaaaaaaatcaaactctcttcatattctggtgataagcagggctaatgttctatcacataatagctgtataacagtgttttaatgagaaataacggaacattatcgaaaataatggtattatcttttgactgcatatcttttttggatgaaaattgaagaaaaaaattctgaaatttgcaataaatattatttattataaagtacaagtagaaaaatgcccatcatgttgccattggcacaacagccaatatttataccatcattatttaaaactacgctctatctataccttgaatttctcccttttatttaattaatctcggtcttatcttgtgtattgttccccaatgtatttcatgcacacctttgtccaaaaaatgagttaaagactttttaaaattaaggttgaaatactgttcaatttttttatgctacttattaattattacgatgactatagggtaagtagctcatgaatcctatatttcttttcaatgaactcaatagtcaattgatactttatataactagtcgatgcaaacatagtcgccggtggttgcacaatacttccattaggaggagattacatgattgaaccatgaaagatgcttcctaaatgttagatatatttgatttattattattttaaataggaaattagtgatgctttcattatcagtttttgaaaaatagctttgtgagtattcacgttaaattggtggctagaaaatgaaaagatgatgtttagtgatattcaccaagttgcctttcagttccaagaatatgaagcaaaataagcatcagaatgctatttccttgaaacaatattccaacaattcaatctactaatgataaaaaaatcatgactcttatcatatgcagtgcatttcattttatgcaaaatatatttcaaatatttaataatgcactagttgggacaatcaaatttgctcctcctgattctatgtcagctcccatattcgagatcggccttttgttccatatctatataagaagagccaagagatcccaagaagagaagctgtagaagggaagaaacttccaaaattcagctgtcatgagaatcatctagccgaagcagagtcattatggccaaactagagtcatctgaccaaaacagagtcatcatgattgaatttgagtcatcaagactgaagccacatcttcatagccgactgactattttcatatcatggtcaactgaccatcttcatatccgactgaccatcttcatagcatagccaactgaccatctttatggccgactgacaatcttcatgaccaaactagtatcataatggccgactgtcaaatgattgactgccaaatatataatcacgatactacaatcatggataataattacatgccacgatcgttagtaagcataaattatccactaactccatgattatggtccgataattggggtaactaccccttagtaccataaaaagcgggaccatgtgctcgacggttacacccgaatcacctataatgggaagataaaggaacagacaagagataagacacttatggattgatactctgtcaattttgatattctactttctctttaccattttccactaacttaaatatcggagggtctccgtcggatacaactgcagtcagtgtagactttttttgcaagtgctcttcaccgacgtcaggcgctccaggggattgatcgcaataacaccatttaaaacccaaatccaaaataatcttcttttagagtatagaaatgctatcattaatctaattgatatattttttaacattattaaatatgatactttacttgttccatcatatatgacaagtattatacccaaaagacttcatgttttgacctcaactacttgagcaaagattgaacgacagctaactaaacactttttgcaggacaagaccttggctgaactatgaatagagacgtggacacccacgaatttaagaatctcaccttcattttggatacagacgttaggaattggccagggagaagagatgaagtcaaaatcctccacaagagtgtctcagtgtcgtagcactctaggtcttctgtctactccctcataataaaaaggctgggcatcgatcaatgccttgaccaaagaaagagacacagtttcttaacccatgaatggaggcatgcgagcttaccttgggcggagtgcccacggatgtgggtttacgatggcttgaaaagaaagagaaaaagaatccaaattccatgacatgcgatggcctgcgagagagtttttatctcccagcctgtgaagagtagcgggttacaccgacgtatcgcaagaagttcaagtttatcgtacgactctaatgtttcccatctcaccgatgcaattaggctgagggtgaccgagatccgtaaccttaaaatatatatatattttttttaaagaatgaaacttaccgagtttaaattaagggtttttttattttttaatatttttcttaaatagaaatgtgaaatccaatctcaccctcaccccacccaaccacacccggctcttgctcttgccagccatctttccatccgatgccgagctattacttgttcttaatcagagtcggttccaatatccccattaccttttcctctacttctccttcgattgcctttttgcctgatgttaatctttctcccatcctcgatcatgccactgactctattcccctatgtcactggtacttattttaaaaagaagaaaaagaaatgagttaaatatattttttgttatcaaaaatctaaaaaataaaatttatatttctagattttttttaaaaaaaattaataatgatgccaaatataatcaaaatcatcttgaactctcttatatatacgacaaactcttgagatttagatacatctccttgtatgttattagtgttgattagaaatatctattttagccgatccattggatatctgatctgaatggaatagattttatctgatccgattcgagcctagattgaatatggattttagaaaaaatatctgaagtagattcgaatcggatatggataatggtatgtcctaccgatctactccgaagccaattagatataatcttaatatatatttttctttcaaaattataattattttataatatttatatgtatccaatccaatctaatccaatcccacccttcttatctattcgacctgattcgactcgagatgaatatgagatgagcatgaaatttttaattacggaatagatatggatattaactgatccaatctatcagtcaatatctatatccgatctgttatcatccttagtattgacacgtggataagctagcatactgaatctatattttatcttatattaagaaaagggatgggtttgggataggttaaggattaaatttgcatcatgcagttttgggttcagcaattattttccttgagatgtgcttccccaacttctgaaaatatgacatttatgatcaattaattgacttgttagctggtagacaaatctgtttttattggggacgtaaattttctctgatgcacttttaatactttccattatcggaggttgctccaccccttttaggacgtacttgcttgtgtgcagggctggaggcagcgaaggggaccatggttacaaatgttttgctcctgtgagcccgtgtcattccagagcaatcgcttgtcaagatatgggattttgtcagaggatggtgggcctctccatctaatcaaagaatctgcggtatatttttttctccatcggacgtagtggacggagaattccgcctagccaaagacatcactttacaattaccttgaatcgttgcaggagggtttgtcatttattctattcaccatacaaggatataacaacaatagtttgataataatcacatgaaatgcacaaacttttgtaccgtattatattaaaatcttccacacttgctcccgtcacctgggacaaaaagttttatttgcatataaacccatgactccccttaacttcacgcaccggtgcccgcaaccatatgtcagttgcatttatgtcccccgattttattttacacctctccatccctcagaacttgaagctttgcatcaattgatcatgtgaagtcaaaagttttagattcttgaagcacacgcaatttcctatctggattgttagtgtgtcaacagtgacaacatgtacaatttctttgagccctctggaggaggaataaaggacaaataaaagggatgggagaataagagggtgctacttggtgaaaaagcttaaatccatatttttctttgtacttagaatattggtcaagcgaagcaactaatattttgagagttagtgtacaaatataagaaaatcagtatgtaaatatttttaaaaaaaatcaagaaagtaatatgcaaataaagattttcgagatcaatatagaaaaatctaaaaattagtaccaaaaagcatatcgctgcagaagaccgggacaacggtttttctgggtgagcatcgagtgccttgtggttagtgatcattattccgaggatttaaatcaataaagtaccacccatcagacgtcgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttgaagcatctagccagagattgtcctcaactcagggatcggatgagggcactgcagtgatggccagtagcaactcaaagggtgatgctttggagatatctggtgaggtatcaacttctttctagcagtggattttagattctgcatgcatctatcatgtatgttgcagagaggagcagtttgactccctggagagcagtgagagcactgtttatttgccggatggatcgagttgtgcaatcaaatgcattgggatgatcagctagagaatacatgatggtgcagtgagaaacttgggggaggtccgatacatatccgattttagatgaaatcttatctcactgagtagactggattcgagaggctacaggacggtagccggtggaggaatcttgaaggtgctatgcgacgttaggattgttctggagggaaaaaagagaatgagaggacattactatctagtggggagtccagtacgaggtggagcttccagagccaagaggagcccagagcgagatggagctccaggtggaggtagatcgggcactagacgggagactcggaaagatgagaggcgatgtcgtatggtgagatttctattaccgtaggagacttctccgagcaagtctttggttagagtggacatagctcatgatggaggtgagatcgagcggtctggctcgactcctacatttgtccatccatgagacagcaggcatgccccaaggcatgggggtaaaatggatcacaagctctcagagatatgtggaggtcgaatattgagtcgaggtaaagattgttatgaaatacgtctcaagattcagttcacattgagcccacagcgagatccaggataacgaacgaagtctaaggagcctaagaacagcccaaacgaagtctaaacggtgaagatatgcatgaaagaaggatggcacggtgcattaggcggaggccggtggtggcatcgcgaggcccggtggagacgagcgcacgcaggtgcgcgcggcccagtgcgtgagcgggcccagtgcaggcgtgcacatgggtcggcccagtgcgcacgggcgacccagcacccctgtacgatccaccgtggaccacagggcgctgggctagccatgggaccggcgtggatcgaacacgcggtccacgcgtggttcagggtagtttttgcatgatctgacggccaagatcacaaccgaactcgatcgaacgactgaggttgattccaagtttgatcaggtgatcagtggccttgatgtgcacgatcggacagctctggtgcgagccgatcacgattgaacggccatgaatgattctaggcttgattgggattttgttttttagtgtaacagtgttttagagtttctggagtctatataactctgattgataagtcgtcagttgtgttgggaagctggtgacgtcctgtaggtgtagaaatacttcaacagagattttagatagcttttgtgagggtttttaagattttttttgaaagactctggtataaaggttgagtggtgagtttctcttgtattgattttattttattctctcatagtaaagcttacacgttccatgaagataggctcgaggacaatccacgtatttatattatattttttattttttttttctactgtatcatatggtatcggatcctggtgtaacattttttctcgccaatcgccttcttgaccaaacagttcccgcagaggactattgtaacggctgccatgtgggtttcggcacctttatattatattataaataaaataatagggtgtatagataataattattataatattttgtttagtattataatgatctgttatgacataaataacaatttttatcctacaccttcctctaggtaaaatatttttaataacttttttgcattaaattttgctccaaaaacgtttgtaaggtggcacaaatattatataatttttatccaatgaaaagtatatggaagatttccttaaatggtgggagcaattatggtacaactccctcccaattgaaagattatagggagacttttgcatggtagaaggtttcactataaaatagacactaaagcatcacataattgaggaaaaaactagaagacatgatactaatgcaatgcactaaattctaaaatgaatagcattaatgaaaatgggttcaagaactagaactctaaataccattagagtctcaaaataaaaaaaaaatagattctatttttttaaaaaaaaactatcccactaaaaaataaatcatattatcattacggaaagagcaacagtccattcataagtgcagataccataagaattaaaaaaataataaaaatattactgataataatataaatataatagaagaaatagtcaaaaattatgtagtcataatttctatattgcaaattaagacgatcactcaatcacatatggcaactacaaaccaatttcttgattgatggcttgactttgatacaataatacatgtctgcaatgacaaagaacggttcacaaacacgaagttgctgctgttggacaaggaatatagatgaaaaaacacaatcttatcggagtgcttagcaagggaacaatcgaactccacttctgaacagaagctttattaaatatactgcatgttctagaaatttaaaaaataatttcaaaaattaagaaaaaaaatcctgtatatgctagccttctacataagaacggtttaaggctattctttagtctggtaagttgattttatcgaagaatagaatatttgttgggaaaggttatatgttcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttatataataattttaaatataaaaaataatttaaaatttaattttaatgtattatgatcaagacatagtaaagataaaaaaagctaaagttttgctctagttaaagcggatccagtctgtccattatcgggtgatgaacgtgatgtcattactagcggacgggagttgtgatctctggacgtccaaccaattaaattaacggttcgatgattccccatcttactgcagcgtcctcccgagttaaaaccttcgagcacctcaaacagctccatgctcagcttatcctccactccctccatggcgacaaccactggctcaccctcctcctcacccgctgcgcccttatccacgcccctctcccctatgcccgcctcctgtttgagtctatgccacacccgaccgcccgctcattcgccgctatgttcaaactctactcccaactggggacataccgagacatggccgccctcttcgctcgtctgtctagtcttgccgtgaggcctgacgcttccgtttattccattttaattaaattgttgggtcgcgatgcgatttcactccacgcccatagtttgaagctgggacatgcatccgatcgctacgtccggaatgcgatcatgaatctctatgcccaacatggtcctattgagactgccgaaaggttgtttgatgaaatgcccgagagaatggtcgttgattggaattccatgctgtcggcatattggaagtgggatcgcaaaaaggaggcgttgcgaatgtttgattccatgccagaccgcaatgtaatttcttggaccgtgatggtcagtgggctctcaagggctggggaattcgaggtggcacggaggttctttgatgaaatgcctgagaggagcattgtctcatggaatgcgatgctttcgggttacgcacagaatgggcaggcagaggaagcattgagattgttcgatcgaatgatgggtgtgggaattcagcccaacgagacgacgtgggtcacggtcatcacagcgtgctcgatgaagggtgaccttagatgtgccgaatccttggtcggctctctcacagagagaaatgtgaatatgaattgtttcattaagacggcactcatagatatgtatgcaaactgccagagtctggcaaaggcaaggaagatttttgaagagatggaggatcggaatttggtgtcttggaatgctatgattgctgcatacacaagggaaggtgatctctcagcagcaaaggagctctttgacataatgcctgcaagggatgtagtctcatggaactccatgatctctgggtatgcacagaatggacagtggattctggcgatcgagctctttaaagagatggcgattgcgaagggcttgaaaccggatgaagtcacaatgtctagcatcattgcagcttgcgggcatttgggggctcttgagtttggaagatggctagtttgttatatcaacgaaaaccagattagattaaacatctcagggtataatgctcttatcttcatgcactcgaggtgtggaagcatagaggatgctcggagagtttttcgagaaatgtccaagagggatgtattttcttacaattcattgatttcaggcttggcatccattggcaaatgtctcgaggttcttaaattgctgaagaatatgggggaagaaggcatcaaaccggatgatataacgtatcttggtgtcttaattggttgtagccatgcagggctactagttgaaggctgcagggtgttcgagatgatcgaaagcccaactgtggatcactatgcttgtaaggtggatctattaggtcgagctggccgattagatgaagcaaagagagtgatagatggcatgccagtaaagccacatgcaggagtctatggtgctcttctcaatgcatgccgaatccataaaagggttgaactggcagagtttgcagctcaagagctcttcaagctcgaaccagagaattcaggcaattatgtattgctctctaatatctatgcatcagcagggagatggggagatgtggagagtgttaggggaattatgcgaaaaagaggtgttgataaaatgatagggtgtagctgggtagaatttggtggtaaagtgcaccagtttgtagctggtgataggtcacattgtcggtcggaggagatgcacaagatgttgaaagaggtaggaaggaagatgagggcatctgggtacatagctgataagagttgtgccctgagggatgttgaagaggaggagaaggaagaaattgtggggacccacagtgagaagctggcacttggttttgcactgcttgtttttgatgctaaggcagtgatcaggatagtgaagaacctaaggatatgtgaggactgtcatgttgccatcaagatgatttcaaagattgaggagagggagattgtggttagagacaacaacaggtttcatgtctttgaggatgggaggtgctcttgcgaggactactggtaaagcctcagcgcgggcttttctcccgctcagcagtcggtggagaatcgccgccgccgccgccggacatgcaagcagctcataaggctctcatcgacaaagtctgagcggccctccgacaatccttggtgatgggcggaggtggggttcgtgccagccccacggacgctcgccatctctggacttgctcgaatgcatctgaacggtgcacggcatccttatatttggggcagccctcagtcgcctcttcttaaattccccttgttttggctgctccattccattaatgttcccaccatgcatggtgaagccctgcatgagtgcactgcatgcagtgagccattacagagatgggcgcgtaatgaatggaacccatactactgcttttgctgattggtggcatataccagcacgatcttgcatgcagtatccgggataatttctcgttctcaacccatgtccaatttttgctttgtattgagtctacaaaaatcttaaagtagattgtatcattgtgcatacacactatgttgattaaaaaaaaaaaaacgaggaacatggatcctctgtagtgcatacgcagtataaaaaaatggacaaccatcaaagaaggcagtccatgagcaaataccatgttatacgcgacatatgttgtttgatggccacctatctcttgttggtacaacagagttttctgcagtgcatggacaacaccgctgggaatcctctttgaagtatgcgacatgcctcacttctacaaataaataaataaagaaataaataaataacaaaaataaaaaaaaggacaaaaaaacaagaaataacagttgtcaatacgtgttgattaggcaatcccatccatccaaggtttcacgaagctcctgaaaatgaatatcgcgtattacaaacttccaccctgtaaatagaacataatgatacttctgtgagaggcaaaaacatcaagtgtgcaaaaactcttgtccagatgcgacaaccatcgtctagagaccagaaaggctgtccaaactttgcccagacctctttaccaaaagaaaaaaaaaaaaaactttgcccagacctaataaaaagatgccggttgctagggcccaatctatacatatatacacacacaaacacagagagagagagagagagagagagagccgttgtccagaagaaattatgcacatatttccaaccttcggatttgacaagacagcataattctttgcacaaccaaaatcaccaggattgttgaattgctttcctcaaaatacggggaaaacaaaaattgaaccgcaaaccgctgcttcttcacaacagatcaaatacgcaggtatttggcaaaacattaaccacaatggcgttggtactcggatcagctgcagagtagagaactgaaatcaaatagctcgatgcaggtgcgcctgagaccgggaagtaatgcgccaaattatggctgagaacgatttatccagcagaaataagcagaagaaaaagagattaattaatacatcaagtgcaatcaaatgcgcgaaaagaaaacaaaaaagacttcaattgcaaaggttcactccacaactcacacctaactctgtttcttccaacaatgtagtttagaacattagatatcactcatgacacccgaattcttacccaaagagacgacagtaactaacagtaacataccgaacgagaaattaattaaattacgcctgaaacctagaaaagcctgacttgggcatgcaggtccaatgattgttgcatcccgaaatggttttcctattctaatgcatctgcaatgatacttgtctatgctttcatgctctagcccttttgttgctgcatcctgggcatttgtactgcttgatgtgctcagccctagcaggtgtgatcctgacgcacttaccatggaaccatcgctcgcacacatcacagcatatccagaattcatcatttgcataattgtccccacatgcaccgcacaacgtgttcccatgctcctcatcatcctcttcctcatcctcttctccactctcgtcgtcttctttcgggggaggtatctttaaggtctttgactctgcctgccgtgactgctgggaagcgaagatgaggcggtaggggcagcaaaaattagactcaaggtgtcagacgagaaagaagaaaacaagacattcaatataaggaactcatatataccatctttgagcttgatttgttgctcttgctactgctgttaggggttttgtctttcgattgcttcttagcagttccagtcacaacctcatatatggtggggagattattgatcatgttgaaaagccgcctcctgtaaagttatgtgataagataaaccatgccaggcattaacaattttcatctagtaagtcagaaaagaccaaatttcaataaagagatgtggttcctcagagaaagctgcaaactggaatatcatatacatgagtaatgacagaagatatcttcagcagtctaccaattaaacagggaaagtaaatacaaagtaataactgtaaatacaaccacaacatagggcaaatatttgtgcaaaggtaaaaatcttcaggtttgaaagctgcagttcaccacaagaacatagatcataaggtgcaagcagctttcaagtttgatcaacattcagctatatattagcagtttcatccataaataggcgttgtctaaaataagcagtctagacgaccaccacccaccccaaaacaacaaaaacaaaaaacaaaaaaaggaaaaacagaaagcagcaaaaaaaagaaatggggaaaaggctatgcaaagaatctattacctgtacaagcaggtcagacatcattataaaggaaaaatacaaaatcaaaaaaagcttgcatatagaaaatgaacttagtctctgatccatgatcgagaattaaaccatcatgatatgaagtaaacaaggagataaattaagctacccaaataacatgagaattaaagacacaagaattaatgatgcctgaatatctaattattgaacttgactcatttgtacggaactatgatcctcttcagtgtatatccataaaataagtctaagtaatacctttgtctgcaagtcactttcaaactaggtcattgcacaccagccgttccaagaaccattttgtaggcacacaaggagatcaaattagtatagattttgccccaggtatagaacaatttgtattattatagtaagaaatataaaatttgacaccatcacaaatattaaccgtgcaatgtgttctctttcttcgcagtactatcaagtcatatttgcaatttataatagtgaatcttcatgacctaaccaagtcacctacgaactacaacagcctctccagaagcccaacaacactatcttactcgagaaaacattgatattggttcatgcatatgattatttaagacaagaaaggaataatcctgggaaatcattgagcatctttatgcagctaggtccacattatgtttaactctttatcggcatcgagacattcaaaatgcttcaaataattagtctctgggtgcaaattttgcctctagtgctttctgcaaaagctacttatccacgtgtatcatgtgctttcagattttaatagttttctaacagtcaaatatgtttgtatacagagaagtttgtttcaagtatatttccacctaatcaactgtgttttgataactacgtaactgcacccctattccctaattctctatggacgatgctccaagttcaaaactagttagtgctcctcaagtatttggacctaggtaatttgatcagctggatctttcctccctttttctcaaacaagaattactctacaagtgtttgctgctaaatccttacataatttcaaatcctatactggcatcagtgaaaggttaaggtgtcttttcattgtaattgaacagaaaacagtgacatgcatggcaaccaagtacagtaatcataaccataacaaaacacatcatcataattgcgtgtcttttttctaaaaccaatcccactaaaggaaaccacctttgtcaacaacaattgctttaaagaacttttctcgcaaatgtcatcaagatttttgtaggtcctcccatcatatttccacatccttttaccaaattccaatcccagttccttacccatcagatctttaacacacatgacactaccagctctttttccttacttgcattactttaaggcttcgccactatctaaaagaaagttcccctcaatctcaaaggtataaagtaagtacagaacaccccagaactatcaaccgccaccctttcatccacctaaatatgtgaaagatattttcttctaaatctccattgtttcatataacaaatgtagatagcaaaatataatattcatgtatttttgggccataacatcagccttcctttgactttattgccgctaaattacattccacatgttaaattctggttcacatgattaaattgaccatcattctccagagttttcctccaccattttaaatttcacactcacccctattaaatttttaattgtctcaacacatttgcagataatatacaaattggcacatctcttcaattaaccgcaaccagttgatcaactatggattcaccatgcttaaaaaactccctcacctcatcacaccaaattctagttcttggaaggcattccttcctatgcccttaaagatatcaacataaatctagattggtttctttctttagcaccaacaaaccagcttattctaccattctctcttttctgaaaaaaatcaagtaacaacaaggagtacattcatccttttcataactctttctatcaatgaccaagaataaatatagcaaccccccaatttaccttcttagtgcaaagtcaaattagatcaaatcattctactcaacatggtgttatcattcttactagttccttcccaatgtgtatcttaaatctacgtccacagaaattaatgcaattcatctctatttattttgacatcaccatgatcactcatcttccattatatgggatttgtcgtatcttcattaacctgtataagattgtcaatcgaataaatccacatcctcagatacctttatataccacatttggtattctaaacagtcccatactcagctctcttactttttttcttttccaaccttgttacaagcaattatataaattataatttatgctatgataatcatgtatacttccacctcatctacaaggcttccatcaacaaatatggaaataacttcttgatcaccatttgcacgctcaaaagcacagagttgcaaggagatgagagaccaggcacaattgaaaaaaagttgaagtggtatcataaatataagtcataacagctgtaatatcaagatacaaagagatatacattgactaaaatgacatgaatttactaattacaaattaagctcccctccatgatcaaatgaaatggtgtatcagacatgcatctcatcactagtagcatcaggggaagagggttgatgactgtgcgggttgcatagaatttatgatacacaagttttctatacaaaaggaaaagagggaagtgggggcgttggggtgtcgtaccgcccaagaaaaaagaaatctaaacaagatttctttttggataacatattttaaatgggctgttttgttacatggctatttactttaccactataaaggtctacataatgttcattattgatgcccaatgactctactgttagatgtatgtcctaaaagccagattggttgaaacatgcacacactctagcgacataattttataattataaatttgaaataaataaaatctggattattttttcattcatgttgtgtttaaattgtgtccatgaatcgtccgaggaattaacggatgataacacgtattctcaaaaattgagaatttgaggcacgtgtcattagtggttaatttctaaatgctctcgttcgatagaacgtcatggggacgatgattgatccggacagatcgatgcatggatcacttcccttcgtgaatagatgagtctcgagtcaagtgtggggatacttgagcgaaagtccaggtgcttaatagagattaagagtactgagcgtgaccaacacgagaagtcactagaatggctgcccactcgtcggtgacttgctcaaagttgcagtggtgtagatagttctttaacctgcgatgcctcagctgcttacagcaaggttgctatagtttgactgcataataacttgatcttctagccatttggagccttgagatgtatgttggctacagtagatccattgtaggaataggatgagcatcaaaatgaaatttgtcgaccccgatagatagagagagatccaatgtagttcataaaactgagtcctaaaatccatggtcatggtagatgaatgatgaaaaaaaatttcataagatttcacatggactcgagtcaattgaatctgacatatgacgaacgaacaagtttgacgagttatccttaaccagcatcttatcgggactcacgatagaagaatcgaactgcacctagaggttcattattcagttctaatggattgccactacatactgctaggtgtcactggtggattgtgagactaattaagaatcgttttgataatcaatgattcttaattgattgaattggaaagagttccaatccttcgaaaagagtttccatgatattgttgatagagatcacaatatatcttactatcggatggaattagacctatggggtcacacaaacaagaattttgatctaagattgcacaattgggctaagtgtagtctgattgagttagaattaattaaagtcctagctttgggtttaagaaaaccctgctagcatatggttaaacccattttttcctacttaatttgggttccctatcggataagactcaaccaaattgaagcaagctcatttagaacaccaagagttggagtccttaaagcaagccacccatgtaagaattaaatgatgggagggggtgccaacacatgttttcttcgactagataagaggcacacgccggcatggataagatccatgtgtgtgccgcttacttggagataagggagggagaaagagggataaaacccatcctcttgcagataaggacaagaatgaggaggttacatctgaattcaaatttgaatttgaatatggattcgaatttgaaatatttgaattcgaatctgggaggattgagttgagcgacaactagcctatccttggtgtacgccaatctgaatttttccttggttttgtgcaataaaatgaggtgaaaaatcagggtaggcggcagcctagcaaagtcctgctttaaggcatttgatccgatcaaatgtctataaaagggccccaatcaaatggtttgacaacttttctcattagaagaaaaatcccaaagcccttctctcatatccacgcctcctctccctcttctctttgatctctcatcctctcccacgtccaaaggtgttgggcggcccatctggtggtatcgaggtgtcgagttccatcgatatacgcgaaggaacaagaagacagcgatcaggccttgatcagaaccctatcgaagatctgattgaaggctaatctaggagcttgcagatccatctaagagtagacggatcgaaaacggagagagtatcctaatccgaatccaaacggatacctgtagaggccggacacgtgcacggcttaacagcgaacctcaaatccacgatcatcggtttgcggagttcatctacccgcacaaggtgatgatatgatcatcattaatctcatttaaaattgttttaaatttctgattttcttaatctagatgcatgatcgatcttgctacgatcgagatctgatcttgatcggatcgcatgtcggatcgaaaaatttttgaattccactgtaccctaatcaaatcgatcggacgtgcgatcattccttcaactgatatcagagccaggttgtacagatcatgcatcttaaattaagatcagatctaaatcaaattagatctgagttgtgtttagatttgaattaaaaacgattagatctaatttagtacatgaatctgaaattgcattagatctagatttcagcttttcaaaatgatcagcgtgtttaaattagatctgaattttttgctcttattaggactgatttttatgctgaatctaaaggttatgattaaatctgaaacttaagattagagaattaaaaatcagaaacctaattaagtgcataaatcttaacataagtgttatgttgcatgaggtgtattttgcaaaggatcatgtctagatctattttgcatgagatgtaattagatctgaattacatgtttataatctgatttttatttgatacatgagatgtatgttaaatctatgttgcataagatgtatgattaaatctaaaatcaaatttaataattagattaaatctaatttaaaacatgtaataatgatcctatttatacatgagatgtatgatatctttatcctttatgcatatatgatatgtgtagatgtagtgtcatttctaagtagcttagtactcctcaaagtccatggtaaaagccgtcctgccatagaggactatgatggaagggatgccgcatgaattgaaaggaagaactgcgaaatgaagaaacttaattttctacaaaaccctagatccaaaaaccctaggatctgtttgtatatgttgcatttaagttgtttagaattgaaaattatttccacatctaaactagaacttttaatgatgcacatataatccgaaacattgaaacttgtggctgacacgcctgtcgagtcaactcaatttttgtttgagtcgactcgatactctgatgagtcggctcaattggcaaatgagtcgactcagttgtgcagactgaggcttacaggatttctgttcgtcacaggtgagtcgactaagtctcagagttgagtcgatttactgtgatgagtcgactcaaatccagagtgagtcaactcaattctgaggacaaaaatttggtatgagatacaatgtaatgtagtttagaactaaaattatttcgacatctaaactatatccatgttcataatgcacttaattaagaattaagacatgaatctaagagatctaaaattgagaatttaagatctgaagtctgcataaaacatggggttttgggtatgtatagctcaataagatctagttttgagcgattgatcaaaccgaatcaaaaattgattaggattaagtcaagcgtgctcatgactaatccaatagttgtagattggttagatcgattaatagccatatatcatcgatcaactcaaagacctaatttggctcaatggttcaagcccgagtctaggctgacctattcgattctaattgatcaattgatgtctaaggcaagtctcgattgtgatttttaattgagatcatgcttacctggccatgcataaattgtgtctaagacaagcatctatatccctcccaatgatcacacttatctgaccaacttgatcgattaagttttgaattaggttgcttgatgattcgagctagtccatgccactagattaatcataactgttatgattaattaaggatgagacctaaatcaaaatctcctcaataatattaagtcgaggggtcttccaccattatagagtgccgtgccctcttccatgttgactgttctggactggatacagtgattcagttgcatcagaggagaagcaactactttatttgtagtaggatgaagatagggttggacctaagatctgtcagatgaagatccaatgacggtttcactcgcgctcaatggtgggtctgacttaaccaaaaaatgaaatcaaaatctatcagatgagatctcagaacttagagaccaaatctgctgctgcaatttacttgagaagcattgggcaagagttgaccacccattggttgacatattcaccaagacctgtcaggtgaggtggtgtgccaattggtgggaccgcagtacccactaggaaccctaacttgcgaaggagtttccgcttcctaacccgaggagtgttagaatccaaagaaatagtgggagctccgcagaaataatgagaactaagtttgtttctaaaataaattctctagaataaactaaaattaattacaaaagtctaactaaaaatttcctctctgtagaattttgtctccttctaatagtctagcctgcatcttaaaaatcaaccaattgtcaagttccaactataaggattggctaagggacttgaaaagcattttgagttccaagaagctagattatgtcttaaaccaaaaatgtttattgggaccatgaagtgttcaaaagacacctttagaaggtatgtcggacttgctcgtgattgagactaacctagcgatttcttctactaccagtatacacttgtgcacttcaatgcaaggtcttaagaaatgtagaaggttgaaacaaggagagatgaccctatgagtaagcaacagagcaaagattactgttgttgtcgtagggacctatcttcttcgattaccgtctgatttctatctagaactgagagattgttactgtgtacctaatacaagcaaaaatttgatttttatttcatacttagcacagaatgattatgaaattagtttcaataaggaccattgtactatttattttgaaaataaaatgattgcacatggtcacttaatcaacagtttctatcatttgcatgttgctgcagatgaatcaattaatttatccgagcaaacagtgagtgacgttggatctaaaatattcagagatgaagttaacctaaagtacatgtggcaccttaggctaactcatatcggagaagaaaaaattgacagatcggtgaaaaatgatcttttagactcgttctcggatgagtcgatttcggtctgagtcctgccttcagagaaagatgaccagactaccctttgtaggacacgaaaaaaagaccactgaagtactaggtctggtacatagtgatacatgcggcctatttgatgtgccggccagaggaggttctctacttcacctttaccgatgatttttcacggtacggatatgtgtttcttatgagacacaaatctgaagcctttgaaaggttcaagaaattcagatttaaggtagagaagcaaactgagaaatcacttaaggtacttcgatcagatcgagggaaatacctaagtgaaaaatttctcagttatctcaaaaaaaatgatagtctctcaatggactccacctggaacgcctcagctcaacgggatttcaaaacagagaaatcagaccctattaaatatagttcgatccatgatgagcttcaccgacttccctttatttctttggggacacactctaatgacaatcaattatttaattaataagattctctctaaatccattcctaccacaccatatgagatgtcgcatggtaagaagccgaattttggttatctcaaaatttgaaaatatccgaccaatgtcaaacgacaacgacggataaattagagactaggtctatgagagctcgttttgtaggatacctgaaaaaatctttaggatactatttttacctcccgaaggatcataatgtgattgtgaaccagcatgccaaattcttaaaaaaagattttatcaagatggagatagtgggaggaaaatttagctcgaaaagaatgtctctgaagaacggcgagtcataaaacctaaggaacccattccatctcgtagatccagtaggatcacacgtcctcctgaaagatacatggatatactggaaaaggatgtagagaaaatgttcctcataggtgatatgaaccatgctgatgatcctaaatctatgacgagacgatgtcagacattgactccaaaaaatggttggaagagatgaagtcagagattgactcaacacatagcaaccagatctggaccttagtagatccaccagaaggaatagttcctattgggtgtaaatagatctttaagagaaattggatcggatggaaaggtggaaacctttaaaactaagcttgtgactaaagataatagtcaacgcgaaggtgttgactatcaagatatctttttgtcaatagccatgctgaagttcattaatacactgcttgctattacagtaactcatgattatgagatttggcaaatgaatgtgaaaactacctttctgaatggatatcttgaggaagatatatatatggagcagcttttgaattttacatccagtgatggagatcacaagatctgcaagctaaaaagatccatttacggactaaagcaagtatttcggagttggaatactcgattcaatgatgcgatcaaaaagtttgatttcatcaagaacgaggagaaatcgtgcatgttcaacaagatcagtgggagggctgtcacattcctcacattgtacgtggatgacatcctcctaattcagaatgacatcctcatgatgacttctatgaaactttgattgtccaaagagttctccatgaaagaccttggagaaatatcctatattctagacataaagatttatagagatagatctaaaaaaatgcttgatctttcacagcaactgtacatagagaaagtgctgaagcggttcagcatggagaatttcaagagaggtatattatccttcagtcatggagttcatctctccaagaagatgtgccccaacacacctaagaagatttagcttataagcaagatcccttatacttctgctataagaagcctcatgcacgctatgctatgtactcgacctgatattgctcttgctgtaagtatcacaagcagatatcagtcgaatccagatgaggagcattggattgctgtgaagaatatccttaaatacttaagaatgactaaagatctcttcttaatttttaaagatttgcgggtacagagatacacaaactcagactttatgtttgatattaatgatagaaagtctacatcatgttttgtatttctgtgtaacgatggtgcagttagctggaagagtttcaagcaattgattattgcagattccaccatgaaggcagaatacatcgccgcgttggaggctgctaagaaaaaattctggttcaaaaaatttattgcagagctggatgtgatgccaccagatgccattccactctgctacaacaacaatgatgccataacactcactaagaaactgaggtctcaccagaagtccaagcccatcgagcaacaatttcatctgattcacaaatatctcgagaaaaaattcgtcaagatgcagagtcaactccacagagaatatgactgatccgctgaccaagccgctgagccaacagaagactgaagctcaccttgagaagatgaggcttaagttcatggtcaatagactttagaccaagtgagagtttattagatgtatgtcctaaaagtcagattgactgacatacgtacacactctagagacataattttgtaattgtaattttgaaataaataaaatctggattattttttcattcatattgtgtttaaattatccataaatcgttcgaaaaattaacggatgatgacacgtattttcaagagttgaaaatttgaggtacgtgtcattagtgattaattcctaaatactcccattcgatagatcatcatgaggacaataattgatctggacagatcgatacacagatcgctttccttcgtggatggacaagtctcgaatcgacagtgtggagacactgaagcgaaagtgtaggtgcttgatagagatcaaggatactaaacatgactaacacgaaaagtcactaagatgactgcccactcgtcggtgacttgctcaaagttacagtgtaaatagttctttgacttgcggtgcctcggttgttcacagtaggattgctgtagtttgactgcaccataactcgatctcctaaccattcggagccttgaggtgtatgttggctatagtagatccattgtaggaataggatgtgcatcaaaataggatctgccgaccctgatagataggaagagatcctatatagtttatgaaacggagtcctaaaatccatgatcatggtaggtgaatgatggaaagaaattttcataagatttcacatggactcgagtcgattgaatctgacatatgacggacgaacggatttgatgagttatatccttgacctgcgtcttgtcgggactcacaacggaagaatcgaactgcacctaaaagttcattattcaattctgatggattgccactacatactgttaggtgtcactgatggatcataagactaattaagaatcattttgataagcaataattcttaattggctgaattagaaagagttctgatccttcgaaaagagtttcgatgatgttgatagagatcacaatatatctcactaccaaacagaattggacctatggggtcacacaaataaggattttggtctagaattggactaagtgtagtctgattgggttaggattaattaaagtctaagctttggatttaagaaaaccatcctaacacatggttaaacccattttttcatacttgatttgggttctctattagatagagctcaaccaaattgaagcgagctcatttaggacaccaagagttggagttcctaaagaaagccacccatgtaagaattaaatgatgggtgttttcttcggctagatgagaggcgcacacccacatggataagatccatgtgtgtgccgcctacttggagataagggagggagaaagggggataaaccccattctcttgcagataaggataagaatgaggaggttacatctaaattcaaatttgaatttgaatttggattcgaatttgaagtatttgaattcgaatctgaaaggactgagttgggcgacaactaccctatccgtggtgtacaccaatctgaatttctctttggttttgtgcgacaaaataaggtgaaaaatcaggatgggcgggcagcctaccagagtccttttgctttaaggcatttgatccaatcaaatgtctataaaagagccccaatcaaacggtttgacaatttttctcattagaagaaaaatcccagagccctccaatcatatccacgcatgttctccctcttctctctgatctctcatcctctcccatgtccaagggtgttgggcagcccatctgatggtatcgaggtgtcgagttccatccgatatatgcgaaggaacaagaaagctacaatcaggctttgatcggaaccctgtcggagatctgattgaaggctgatccagaagcttgtagatccatctaggagtagatggatcgaagatggagagagcatcctagtccgagctcgagtgaatacctgtagagatcgagcacgttcgcggctcaacagcgaacctcaaatctacgatcatcggattgcggagttcatttacccatgcaagatgatgatgtgatcatcattaatctcatttaaaattgttttaaatttctgatttctttaatctagatgcatgatcgatctaactacgatcgagatctgatcttgatcgaatcgcaagtcggatcgaaatatttttgaattccgctgcaccctgatctgatcgatcggatgtgcgatcattccttcataatgttcattattgataccccactgactttacatgccttgaactaatttggatctcacttaaagatccactttaatatttatcagatagattcctaggaccagagatatttgtttaaaaggtttctatcatcaattgggccattgtagccgaaagaaaagatgatgcattagtccagtcaggaacaataacttcttaagtcccatgtataacattaatatcaacttttctttgcttccgtctgtgttgttaatggttagatgaatagtagctgaagtttacctagctgggtgctgcagacgatcccatttcaaatcaacttttgtaaacagaacccacacatgtccattaactttcttgcaccatcaccatccatgtcaagcattgctccctgaacctcttgctttattcatcaactcctttccaaacacagctagctccttaatctttgctaatgtgatggagcatttgaggttggatcaccacagctccatactcatgtcaaaacacgggtaacagtagattttcttttttttttttcaacacttgtatgcctcaaacagttttccttcaaaacaccaattttgttacacatggtcgctcttaacaacttgatataagaatataacatcgcacaaacactttttatcaatgttcgaaaagactataagcagaaaacatgcaactgctaacctccgagcccatagatgtctggttacaacctccaacaacagcccccccccccctcccccaaaacaaaaaaataaaggaacccaaaagaaaaaaaaaaaatttggggacaaagtttagtactagctgataaattgatcatcgtcataccaagaaacaaaatttaaataatgacctaataataaaacattactcagatacatataatctacatgcatgttaagacttacgactccaagttcaaatcctgaaaatagagtatttgaggtacactttctactaaatagacccctcctccttaatttatctcccagaaacctcaattaaaggtcctttaaatctacgaaacattaccttccttttggatttcttgacgtaagttcctaaaatgattccaattttctagaattcgcgagaatccatgcttccattcaagcaattactgatcatcgattgcagtccatgagcaaatattccctctttaactcaagaaagaaagaagacagcccaaaattgacaatacagactatacacttaaataactaactaaacaatcccaacaacataataaatcttacaataatgcttaaaaatttgtgcataacttttgggtaaaattggctgaaacacctgaaaccagactggaatctgtcagttttggtcaaacaaaatcaagaaagccaaaactaaaggaaacaagggtcaattttgaatcaatatcaaccagaatttaaaatctcgatgccacttgaccaaaacctatagtaaagtcattcccaattttgaacactgatacatactaaatgctaaggatggtaactaacagactaagtatgcaagattaagtatctcagatacgcaaccaataaagaaagaatcatggtttacaaatttccctgaaacatttgcttcataaaaacattctgtaatctgttacttcaagtgaaagaaacaaaattgtcccaatcattgaaaaattgtttcagatgtttcaataaaccacatcaaattcatccaaccatcattattttaagcaaaacgagcaacccacaaaacaatttcaataatgacaggaccataatatttgagttcaaaaacttaaagaagcataggctaaaactgagagtttaatattggaaggagaaaaacgaaacttggttgtttaccatgcttaacaacattacataatgatttgatctaatcagttaaagacaataaaaagaacaaagcattagtaaaaatagcattctcatgcgagaactatagtttggaggccgcatgaataacagataaggagaaagataaaacagtacagaaagaaaagaagacctatctactgtacacaagaagaaaatcttgttagcgaccttagaagaaagggagatgtctttactgtacatgtcctgtaaaggctgcatgctagccaaacttgtcatgtttccaaacccagcaaagtgctaaagtaaacttcctgattctatacgttattatatactaaccatatcatgaagataacaaattttcttcctgacaaacatttacaacagagtgaagaaaagtatgccataagtatctgtaatatcaaattaaacactgaaaccaacaatgaaatttcaaaaaaaaaaaaggtttaagaatttaattagccatgactttggatggcaaatgaaatataatgggcaaaaatgataaatatggtccaaaaaatctaactaaggttagcttatatgtggacttggtgccaaatcaacaaccttaccgtaggttgtggcaaataaatgatttcctattctacaaagtagtcatgcacaaatacatctaatgtcaagaggacaacttccaactaccaagttcttgggcacagatttctgtgtctcatttcttaaaagcttacttgctcagaacaagcaacgagaccaataataactagctgaaaagaccaacacaactcataactttatgctaaggcaactaaaaatcaccaggcatgtgcacataaccaagcagtccatgacgtatgattcaaagtttagccaataaataaaaaaagaagaaaagaaagtaaagttcagaatagaagccacaagccaaaaaaagatgagtttgtttataagcagataatacagaaccattagggttcacatgtatgatcataaatccaccaatctctacagtcataagcatacaagccttttcaacaaataagcctattatatgtccttttcataaacattgcactgtttacattctttagtgtacttagaagagagtagttcctcagcctaatttatactcatcctttgagtaggtcccataaaaatgggatcgttcagcacatggtccccacctgagagcacaatacatttgcaacattcaaatccaaaaaccattttttatttcaggtatggtcttcatctcaaagacaaccttcacaaaattacttggacatattaggatttccaagggcaggcttcattcttgatggaataccctagtagattaccaagaaaaagtgtttgaaagaaaaaaacaacaaacatgtcagatcactaattagaacacttaagcatttgtttccagtaatattaaactatctacacttggtgatgagcttattaatagtcatattatgtcaaatattgaaaggagaattctccttgagagagagagagagagagagagagagagaatgacaaataagaaactacaataacaatgactaattaacaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagaatgcaaatagaaactcaatacaatgcaattacaaacacaaggttcaaaagaagaaaaaaagacttagcatgcttatgccccaattgattgtcctatatagatgaagcagcacttgacatttgtggcaagcaaaagactttctctgatcttaatgattagggagagaaagatgaaagacagaagaagcaacaggcctgaaaaagcaagcagataaaataataaataattctctttttgacctgatgttaggcaaggataagcttctactttgccaaagaagaagatacagttttcagagagtaatgtgaggatacacgcacaaagaagcagatcttgtgacaaaagaggtcatgataagaattaacgaatccacaatgatgtggagcagttaatgctcatccaatttatttaacataacttccaatcatattcttataaaggaatcaatgaaagagaaaaataacctttagttacaagcagaacattacaaatttgtaggtcatttggcaatgcaagaattacaagggtcatgcagaaattaagtcagacttgttcaaggagaacagtcctttttaacttctttacattctcaccgatcaccataattttttttcttcgataactaaaaatcacattagtacagccccataagttttctgcctttcgataataaggactaagatagagtttaaaatttcgcaagaaatgtgggaaaggtcaatgtaacagtacatccaattcctagaagcgaaaaatagaagtgaacacatagaattgcacctggaaaatgacatgccatggtaaaaatgaaaagaaaaaacctaataagctaagtaccagctacaagaggactttcataagacccacattcttgagttgttgttaaaataagcttgcaatcaatttgttagtaagtccagaattctaagtgagataacattgtcaatgcatcagatctttaaagttatctactgtatattgtggggactgccgacataattggttcaaatgattgtccaacctcactttggcctaccatttgacagaagtaactaatgttatatacatcaatcaggacactttcaatgttaccatgcataacttggatgtatcctgtaccaagcagggttttaaatcccgtgggacagggcagttccaattttttcatggaacggaatgcactgccgtcctgtcccgtcccaatacttgggatagaggacgtcccaatcgaagcgctggaacactagtgggacggtcctgtcccaacacatgggatggtaccccatccaagtgtcccactaggacttgaatccttcgtaccaataacatatggtaggccatccaagtcattggatcaacactgttcatctagttctgcatatcttaaaacacatgaagtgaaaatcaaaaaaaaagaactagatttttaggaactaccattccagacaaacttgagttttattacttaattcttttttacttaacaatcatcagccatttaatctccaaaacatctgaaattttggacattcatgatcaacaatgtggatgattgatttcaatatcccatcacattgttttatgatacccaagatgaagtaagtagatacaaatatataaaaatgcattagaaaggggggaaaaatcaaaagaaaggctcagctataatttttgccatgctatggcctacatcagatgcagaagagcaatgagatgtcaccttgctttttacattgccaacgatatcagtacaaataagtagaaaaatacttgcatgaaatcaattgtgctaccttataccttctcaatcagctaagaaaagatactgctgatggacaaaaatacataatattatcatgtaatagtacatatataccattttcaaatgtttaataggttatagtatgtcaagccacatatatgtgccaaatgctgtgttatgcaacttttcatgcattgcactttgttttgattaaaacatgcatgacaccttataacctttaaaaggatgaccaaagtccaaaatcactaatcaagaacatagatcagaattgtgtgaagagatgcaattctttcaaccatcaatccatgaacaaaagaaagcactaacagcataaccacatgcctgacaaatccataagttctcaatgtcatgaataacgaaagcaccttacattattgtctttacatatataaatcagttgctgatgataaatagaaataaagagaagttgcataatgatatacttttcaaggtggaaaagtatttgaatgatgatcataattgcatcgataacagaaaaggtaactacataagaggtcctgctcttaagcacaaggaagagcaccaagtatcactaagccatcaatttttctgtactgtcatagtctcgattccaaagaaaattttacctggcctccttgtcaaacccaaagcgagccccaaaatagaatgcaacagccaacaaccacgcatcactgtgaactgcaactagtgacagccaatccttttcatccatcccatccctggcaaaattaattcctaatgctggctcaggaagctctggaggaacttcctcggcaggcaaatttacttcccaggtctcattgggaagtccataaagacacaagttctccttttctgccaatacaataaaatgttcagtatgaaatatcctcagcatgtaagactcaaactgctgatagagtaaaggattctccagttacataaatcacatagcattcaataatctgtggagaaatatgtagtcgattgcattgcacaaatagtaattacagaaaaatgcattaagtagccattgaagtaactgaaagaattgctactcggtaagcagcagagataatgttttttttaaaacggtcattacacaaaaattggatgaacaaattatgacctgcctacttctaaatcttgtacagtggaagttatacggttatcaatcacaagagaggccttttaatcaaatatcatataccataaccaacaatccctatacacaatataaagaattgtcttaaagcaccttctttaccacgcaaaactccatccatgatctccggaaatgcaaaggcattaagtataaagactgagaaagggaaaaaatatttcagtcccaaacagctacatttgattggacgaaacacatgaaatattatccatagctttcacaatatgacgtaacatctaaaggggccgaaacaacaaaatttgatctttcagcgtcagatcatctgagaaaacaaagaaatcaaaagaagacctgttaaaggaggtgaaaatgttctaataccaccaccggacctaatcgaacaacaaaaccataaatggcggaaccctaacaccaacggatcgaaccaaaaaaaaaaaaaagggaatgactcaccgggatcacatagctggtagaacttgtcaacctctgcaacaccagcaacaaagacataaaaaacatttttttcagaaaccagccacaacacaaacaaaccaaaaatggaaaaaaaaaaagcctcaaaagcttcaaaaattcgagctcaagagtgggaaaaggggagagtgtatgagagagaagaaaggaagagaccggtggtgagagctttgatcattccagctcgccggcctctaaaatcccggaagacctcctctgccgtacgagaattgtacgtccccgcagccccctccatttcccacgcgatagtagaccaggccggtggaccttgcgagcttcaatggcggaagcgagcagggatttcgccctggaatcgcagaacaccaattagacttcagagagcgagagagcaataaattagggctcccaatctctgtcgagagattagggtttccgagagcgttttcggccgaaagggttcaaatcccagctcgatgagaggaagaagtaaagaagcaaactacagagagagaggggaaaatggaaggagggaaggtagcgcgatatggagggttttgtgggtttttatttggtcgggagggttctcattcgttcttctttttcgttttcaggcttttacttggtcctggtggcgtcgggcgatgtgcggtcatcttaccggcctcaaaatcgtagccttgaactatcggaaatgacttccatgtccccgccaaacggaggtggcacacctatcaatccctccacgattcccatcccatttggatgggcatgtggatggcacgtggcaagcattttgtggcatgattttatttttttgttttttttttttgggcatgattggtgcatgcttttggagcaaattagatgcaattcaagattgaattggtgattgctcatagtccttgggagcggtcttgatttgtggataattgcttatgttggcaaattgaacaataaagataggttaatgttgcattaagacctaccacaggatgattatataataaaaagtaattttattgaaaataataagaaaataaaagggtagccatgtaactttattcagtgatgtgtgtgttttatctaatatttttgagatattttttgtaattttttatatcattcttattcatctacaataaccatgaagttaaaaagtaaagatttatctttaattttatatacatatatatttattattattataataatctctagcactgaagccaacaaaaaaataacgagagatttattgtgtgactaatgcctccacatttctattgatagtcttgattatttatttatttttttattagatcgatgatattaaaaaattatatatacacacacgtatgtgtgtacatatatattatgcctccaaaattttttaatattattttgaaacttttagttttatgttgccaacaatttgccctctatatctactaccgtgtcaatcatattatatatattctttgatttagcaaaaatacatcatgtatgatttttgtttgaatgattctgaaaaaagataaagtcaattttatagcgcacatattaacataagcatagcagttgagatgaatattttgatcatttacgaaattttaaattttaaaatattttaaaaaaattaatatatttaacaatgtatatattatatcatgatagtatatattttatttttttaattaatatgacaatgcaagctaggagaaattattagacatgcataaatacataagcaaaaaatctcatgtacatattgtgactcgcaaagatccctctgattatggtccttggattcacgtcaaatcagaataatgagagaggcaagggttagtttatgttatatttttgtggttgttgcttgcacattattgacttgtttattttttttttcaagttataaaacatcagcaacaaaccatgtctaccttatttatgacaagtgaagcctctagataggggagggtgccccacttctaccatgtctgtttcctctttctcattgccttcatcccctcgctccagtggcgtaaacatctctccattttttatttttttttttctttggggtacaataaacgaacattaaaaaataggtggactttgcgttaatatttagtgtttctgtggactcaaatggaatacttggctgtccccgtcctctgtccgtaaataatcattgctgaaatataaaatattttccaaatcggatcctattttttcattaataacaaacccttggagagagaaaaaatgcgaagaggtagaatttacaaatataaaaaatagacgaggttctagttgtaattaaaaagataattccaatcgagtcctccaggaaattaaacggtctaacatttcacactttcgtccctagcctctctctatttgtttaccaatcgttaccatacgcttggctttccgccacgaggactcgggaagtttctgcattcgaggaggaaaagggggcgggatcgaaatccaaacgagactataaaatggacaacgatccgttcttgttcccttcgattagagagagaaggaagagaagaggggagagagagagaggagcggcgaaggggagggcggcgatggctccgctgccggtgccggcgagcgtcgcaaagcaggcggagcaactgaagcaagatgggaacagctacttcaagaaggaacgcctgggggccgccatcgacgcctacaccgaggtatcgtttccggtttccatttatttgaaggcgaaaaacgatttcgtttacccttatagattctttttttcttttaatctattcttgcatccggttttgttcttttgattccgttctcgtggttcttgaagccaacattggctgtttgatcaagtgtcttggtaaaattatggatttttctccctcaaaactatctgtttttgatcaaaagaagaaactttctctaaccccaagtccgaagttcatgtcttggcgctgtcctcctgctctaatcggcttccttgtggtgatcgatatggatgtttgattggatgaattgggttttcaggcaattacgttgtgcccggatgtggcgatttattggacgaaccgagccttgtgctatcggaagcggaagtatgtataagccaccgttttcacttcttgttctttcttgatttgttggattggttgtctcaatggatgttgggctgttgtacttgtcgagtttgatagtgaatggaaaaaagtcgaagaggattgtaggagagcacttcagctcgacagcaattctgtgaaggtaagcttgcatctttcgtttcctccttcatccgttctctttctttgcaatgtttttcctattttttggtatctgctgttgaaattctgtgaactacataccttttttgacaatttctggttatcaattattgttttgtggtttcactgttgctttccgtctgctgattactcgtcatgtcattgcctgtttttcttgaattctgtgtttgtttgatctattgtcacttgaactctgagcataggcagttctggagcaacgtggtcaaagattttaggtacaaattatctaaaaatggatttttggtcttattggtccttttggccaactaagtatgatgctgctactaattggcagtttctgcagtgtatcatctcatggtaatttaatctagcttttgcctttaatcactgctgatcatgttaatctggcaggctaagactttttcatgtgggatgtctccgatttcttacttttctaagctggctgctgtgttgttttgagaaattatgcatgaatatgctttaatacacttatcaatgagacatgctgagtgtcacatccaccatgcacagttgattcactggatgcacatagactcttgccattggattggctttcgttagtaacatattccattgtggtggttctgtcatgcatttttgaattctaaagcaataacagtccagttaaggaaactaaatgaactagctctaggttctcattctagggaatcattgatgtgtttagcgttggggataggtggagaaataaaaaaagtaggataaagaaataatgagggatgatcaaggaaaggtttactaattaaagttcttttttcaaaagagtgatttcccatggttgatgcatacaagcttggggaaatcccatctctaggatacaatgccttgcatgctcgaaatctccaagggctcctctctagggacgttgctgatgaaaaaacccattctggaaggagagaaaagaaaataactttaaatcatagaggcacttgattttttattttgagggggagagagaaggttcaacgttgtaatgcagccatccacctcccttaagaagaaaagtgtagttcttcatttttatctttgtttataaataaaaaggaccattctaaatgttaacccttttcccagattctgtgcacctgaatgacattccacttggccaaatcaaaatgtcaatccaaacctgcttcaagatttaaactgctgaagaccatttggcagtaacttgaccccttcgtcacctgttttggagcttggattggaaaaagtgagagcctcccagataggcaaagctctgccacctctctccataccatctcaagtgaaactaatacaaaactcttaccatggaagcaaaaccaaaaccatgtgaaaacatctttcctttatcatcttattcttatgatgcagtaactctactatggaaacatctagtggatgttttttacttgttgcttgttggtatttcattgtgattgcatgcatgtatcttttgttcaaggaataataattggagtttcctgatttaatcaaaacaacatcatgtttttgttaaagggagtcattcttatctcgtgcttgtgatgagagccatataaggatcctgttatgtagaactagctgattttagttggtttcaaacaacctctaggtcctctattgaatggctgaaactcgaggagtaggtctttgagtcgaattgtgcttggcatcaattgcatgactaacattttgagtgcaccatatgcatggtacacatgtatggactctttgtatgcagaagcttccatagtaaaaaggtgaataaaaatgcatgatggacagcatatgtggctgcaatatatgtacaatgaagttaactggttaaaatgcacaggtccaagaggaaattaatgaactcttgctttatagatgtcagaaattatgagtgttaatatgactttgagaagcttgtaggcagaatatatcttatgagtctgcaaaagaaaaaggaggcttcaaccacattggatgcttaaaggttgaaggtgtaagaaaatttggatagattacttttatgaaagttttggatggggatttgcctatatagcagagtaaaagggtagcctaatatacaggagccattgcagggtttggggagggttagatgtcagcagcctctccaaccatgtgttgagaggccttttttgtgttttgaacatgcgacatgtagatcacaatggagcaactttaccatggtgccaaggctctcttgcttgtagagtgagatggagaaatcacatatagtattgttggcattggaagagactttaacaatctatttagtaggattcaagggttctggcaatctttaggaccatatgaaatgtgggtaaaaatagggggactatgggagatattgcttcactatagagaaactaaacaaaacattgttcatttggattttgggcataagcagttcatttttcaagacctcagttcatttgtgtcttaggaaaaggttttcatggttccactatgcatttcactgcaaggaatcgttcttatgagttagattaatctcaagaagattttaaaacaataacgattcccttaatagcagttgatctttcaatgagtaagtgctatctgaccttgaaaagttgttttcagtagttctattgcattttctttattctcagtaagcagcactatgctacttaagcatccaactctggttctcttttatgttctgctattgggagttgcaaataatcctgttcctggttataattttactggttagaattttgtgatatctgtttcctagggtaagggccctttttatgattctattgaagcagtaacattgtactggaagacattgctagatgcctcaattgtttatcggctttttcctatgtgcatgctgtgttatggttctattgtaccctgacacgttgcagcttgccaaaaatattattctcataacctgtatgttaatagaattcttttcactgtaattgtggtatgcatctatctagtattctagttaatatggtatctgttgtttcgatgactgagtcgatttctttcatggcatccatatacgcacttacgttggggcttgcatgctataatattgttctgttgtaccctgataatatggaatttgtcatttccatggctgagtggatttctttcatggcatccacaggcacactatatgttggggcttgcattgctagagaaacatgattactctgggggaatcaaggaattggagaaggttagtaattctatctaataccacggcactctaaaatacacgaggatgacagtgcattgccttatgtttggttaaactgctattatcttgcaatgcgaattctgttaaccaactgaaagcaaaagaatactaatcaatttgtttgccaacatcattcccatgcagcaaactcagggagcttaaagatagactacatatttggtacttgatcatcagccagttacacttctgtggagttgccacagaaacatgtaacttaaaaaaaattgcacaatgtggaaatcatggtgcacaatttctacaaacatataataaagctgttgaaaagcaaagttagatctacttactataggaactttatgcaagttactttgcattgcggaacatatggcttattctgtcagaatggaaatatatctatctatctatctattatgtgtgtgtgtgcgtgattatatatatatatatatattatttatttattttgggttgatattattcctactagtgttgggcatgtgcaatgcatgtgaatggaaatggatggttgtgttaactttatttgattagatatcctctattatttatgtaattatgttactttaagaatgcaccacttttggctggtgcacttttcttgtttttctctcatagtgatagtgagaaccaaaagaagagggatgtatttattaatttcaggatcactgttaaacatgttggaattggagatggttgaacatccagtccaacatctatgtgggagggagtttgctttatattatgtctaatgcagcaaaatgacatcaactggtgtattttgccaggtgaatgtgcaggaaccaatttaattattgataattataataggcttagaagttcatcaattgatagaaaaatcatatttgacttggtgaatctgagcaatggtgagtcagtaattttaacttaccaaccaaactaccactcaccttgtttggccagtgcatgacatttgccccccccccccgcaaatcccaacagaaaaaaaaaaagaaaaaagaaaaaaaagatttcatcttgcatgtttgaagcagttttaattgtatcttttcatatggtttctgtcctttgagccaatcaaacttatacagtggaatacatgtcaagtctcggcaagaattgccaaatcatgaaaatggattgatatggctgagacttctccaatgtctcagctcaagtggtgtcttattcgcaactttgtaattcttattaacaacttgaatgttgtttaacggtgccatgatcttgtatcataaagttgtgatggctgtcattagaaggtggtgtttgttactcaacagttctggttgatgtcattaagcaatcagagttgctaatgagatatcatggttctgtgggacccggaatctattgaaccagacctccccaaggtaccaccggaatgagttattagttccttgcttctgtattcattcatgcagactcgcccctccttccccactttcactagagagaaaaaaggttccactttctccatgatgagtaccaaggtttttgctataatctagccagcttagataagtgatgtgatgccttgtgataatggtgaaactgaaactgctggtaaaatcggttaagttagttacggatttgcatgcagatatggaggtatctctgactctttgaaggtcaacagctatagaactcaagggtcatgctcgtcaacactgtgaaatccttgccttaattttctgctttttcattagcaacagaatcttctgattaccaatcttgttctacctgtcatgcatataatgtttaatgagctttatctttcttcttgttttagcaagtcatgcagatttatgtttatcattcacgtctctcattttttgtatcgtttaaacatcgcttgggtatctttgtcaatttcctataactaaagtctgtagaacttatatgagataggctttggaacttgggagaggtgctaacccagcaagctacatggtcgaggagatttggcaggttctttccagagcaaagtacatggaatgggaagattcatctagcaagcgggcatctaggctgcagaatttgaggtatgtatatttttttataagttgctgaaaaaggtccatatattgatctcttttactcaatatattaaagaatgcaagcatttgcatctattagacatgacaaaaacttgtatcgtatttcagggaagtatgtgaaaaagctcttatagattattatttcatcgatgcatctgaagctgaagatagctctaaagaaagtgaccattcccaatcccagcagttggaatacctccgtgaggtgttcaacaaagccgcacaagctgatacaccatcagaggtgagccaacttcttattttactcaggacgaccttttttcccctttcctttctagcaataacggttatcataatcgttgatattcaggtgccggaccacttgtgttgtaaaattacactcgatatctttcgtgaccctgtgattactccaagtggcattacttatgaacgggcagtgcttcttgatcatcttcagaaggtgattcctagtctctaccactactcagactccttgctttttctttatgtctatgctttaagttctgacatataatttctcaaaattaggtgggcaagttcgatcctgtcacaagagagctgcttgaaccgcaccaattggtaccaaaccttgctatcaaggaagctgttcaagcattcctcagagaccatggttgggcatacaagatgtcctaaatgttctgattcctggaccctatgatcgaggaggttttacatggctatggttgcgtgcagttgcagcttttaaatcaggattttgtgttgtattcatgttgttacattttcttcagtgtttctcagccttttcactaacctgtgaaaaactttgttgagtgtccgtgtacagagagccgattttatgctttgcagtacagtctgatggttctttatgtaaagcccatccttttgggtaccatttatacagatggatagaaagctttggattggcaatgagcatatatagtctcgggtgcctttctgttttcattcgccacggattttgcaaagctgccaacacttcttgaaagtttgcaccactactgccgttttctatgatgcttgcgttggttctcctctgctctgaatcattccatacccaatggtggattgtgggggctctcgtgtgggtgatgaatggaactatgtgctgttgagggaaaactgaggctcaaggaacgtaaggcagacaagccattgtaaagcctctgataatatgataatataacaacatagcataatataatatcatatattattattatattatattattataatatataataataataatataataatatagtaatataatatatcatataataataatagttatataataaagggtattaagaaaaatatggataaattttgataatttattcaaaaaattagtaatgcaaaagagtcatgtttcaatgtataaaagaacgtaaatatattattttttatgtaaatattatctgtaaaatatttattcaaaaaatataaatttttggataaattttttttatccatagaagaatgggtcttgagggatccttgaatctttgttcaacttctcttaagcagcacaaaggaaagacacaatcaaaagaataaatgtgcttggagagtccaagacgacgaagtggagtgcatatccaatacctcccatgctgctactttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaagggagtttgaacagctgcttaatgaacataggtttgatacttctctcattgtttgagctaattgatgcatgagaagagaattgcatgctagagaaaatttgtaccatttgatgtgctgcaggttacttggcttgactggtgcatcccatgcatggtcaatgtaaaattcaaaacatggattttgggtttatactttatcataagctaaaagaattgccttagatataaccatcttttcatagtcatgtatcatacaaggggctaattctcagtgactgtaatttcaataaattattttctgctactttgttcatgttcatgtttctctctatattgacctttattatggtcacccttgatctctgtttcacatgactatgccatcttaatttatttacataaacatttttgatgtagctctttatcttccacataatatttatctagagaaaattctagtgacctattattttatgtgtgcactggttttgtatcatctttcttgttctttatataggatattttgttgaccacataagtggcttttgtacaagaacctacagtcttgtcttcttcatggtattcacaaccttagtaaacatgtttttttggtttatgtactatttggcgcaaaagggccaaaacttgcttgagtttcacatgtcaaaggcaatattcaccatctggatcctgttgataatctccaccatggaattcaaatgtagaccctatcttcaaaatgttgccgaattactgcaacgaccaatgccaaaattaggtgctagataacaatcaagaaggttgcctgaatgtgaacttatcttaattgtttgataatgccactgcaaagttttatatgggtaaaagtagttggtaaacctccatgtgaaaaattttgatagccatgtggggcttctattcaagttggtgtgcagtggtgaggtttatgttgttggggagttgatctgactagtgtttgacttcaggcacatgctgagtatatcactagctaacttcaaatttgagagccctgccccaagttgatctctttaaaaaaaatatatcatgtgtctgcagaagagagttgtaaagaatatggcatgacctgcccaaaattccagtagataatggagtttattgattacatttgacagaacactgggcactgagcatggctatctggagtgacaaataaagtacaccttagtgaaagcaatggaattttggttttcaaacgattgcatgtgctaaatgtactaacctatttttgatattttaatcaacacttttctttgtcctttgctacttttaatattaacaaaacataacatatatgtgaactttttagtaaaagatatatagttgactaagtaaagattgttcaatcgtacaagtatgttttatagctttgttttgtgcagaagtgtttattgttggaggttaaagtgttggtgattttaggacacctgcacacttaggacccatgccaatcctccagataatatttttcagacaaggtttttcaaaataagaagcttaatggacctattgttgggtacataatgaaagaccttttgtccctatagcatcatgagggacagaatggaagaaattttgcattccaggggaatatggtttagtcatggttatctaatttgctagaacataagcaagttgaggactggtagacatataaccaatgtgcaatatggtttgatccggcatgaaaaggagagtgaattagatagtcaatgcgaaggttattcatttaattcctaaacattctaattttattacctacaccaagcaaatccactcactagaaaatcaacaaattgcaagttgctggccaaaaccaagtaaagcaagcaactggtgatgatggtcttggaaagaacaactaattatgcccatcaaacatcaactctagaaaatggattaggaaagggttttacttttgtcatgaataagcagtgcatgacataattttccaccaatttgcttatcatcacgtatggtatgttgcctacatctattgtgatcctcacgaaattgatgagaatggaccagaaaccaactaatacatcaatataggtggtttttttttaaaaaaaaaagaattcatatttttgtttgtaaaatacaatttcaatggcatttcattcatagcgtatcaaatagcacccttttcaaacttagaagtcagaaacctcgctgtgtttttttgattacatgtaacaaaaaaaaaggaaaaaaattgccaaaatctatcaaaatagttgtcatatatcctaattttattctatatgattttttttccaagttccctggattttttctcttataagttttggaccaacttttagcattttaattcttcccactgactgaaatatgctctgatcttgacttttcaaaccttgatgctggattaaaaaaatgaccttgccggtcaaaccacgtgaagcaagactcttctctcaattaaatatcagccttgtaagtaatcttgttagcttcaacattaaagttctcagacatgacttaaatcattagaatattatagcttgttattctttccagtatggttacagaaatcattaactggcatgtgactgctatagcttttttgatggttttgtgtgatataataagctgttattgtacgcttctggttacctatgtgaacaagcaacctaacatcttgcacatctagaacatatgctgtgaaatataaaaataattgatccgtgggctattagttttgtatcttgcagtcgaacttttatgcagaaattgtccttttcggcagtttttctgattcaactttttcatcaaactggcaggtcaacttccatgcaaggaaaactgctccagcataatctaggccctgaagtagttcatgcactcaaggatcttaagaaaaagctgtctgaagaagaatccatgtaattaactttcccagtgggctccatcgcatacgaagctggttaatactgccaataatcacatgcaaatgcaaattggaagctcaaacgtcaagtgatggatcaatgacaggggggatgtaactaatgagggcctgtttcaataatcctgttcaggcttccatttattaatcagtattaggatattgggatgcttttgttgattgttttcagtttcggcagattaagagcttacaaggctgggaatgtggctcttaaaccatgaatttctttggcttttccattatttgttgtttgtattattgaacaaagaaagaaagcagttttctttttttttcctgtggcgaatattgtgcgactgttgatgtttcctcattttggttgcctgcatcatgacgatcttattatctctctccctctcaaagagattgcggtaatgatattttttgtataaatgcaaaattttgtccctgcaaaaccttgaataaagcttaaaagttattcagggcagctgttcatcaattatgatgaggaaaaaccagcaatgcaaacagttctaatgatctcttggaagcccgctgttttggatctcaccaaagtccaaaagttttaggttgcggcctgtcttgaatcagcatcagcacctttcaagcggttccatgcatatcatgtttcatgtggactggagcgttctccgtaactagccttaatttggttgcttgtgtgaaagtgattgatgtatcagatgaaagcagccttggaggccagattctcggtacatggattaatctgatggcagacatttgtgtaacaatgagactatggcaaacaaggcttggctttttgtatgagcaaatccaggtttgaatcaccaccaacgttgtttcattatcctccacaattattgcaaactatgggtgaaatatttttccatatctccaccttttctttgagtaagcctattaaactatgtgtcagattccttccagatatcaaaatgtcacctacatgcaggcaaaatagaactgaactttttgctggttttgctatgaatagtggctactgctaagcttccatttgtgattaggagttttaatacaaccactgctttactaatttgcaggagatcaacgtctccaagattcgaacctcctcaccaggcatcctgagcttgtcttaaagatcagcttgacatgagcccaattcaggtttggtaggaagacaaatgagccgaggttgaacacagttcacaggcttaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagccaaatttgaccttaaattcaagttcaagaacaatcttgaacatcctggtcaagttcaaacaaacaaaaagcagcatgctccatcttttcagctaatcatgccatgtgcgatttctatcttatcaaagttgtcaaaaccaatcttgctcgtgccactagattgctccaagttgatgttctgggtcacatctagacaatctaaaaccatgagatctttcaaatggagaggaaaaaaaaggcacatatggccaagttctgatcagttaatagctgtcaaagaaatcttttttgttttcttttcctctgttttttttttccattgtgaccctcgcatcatcaagaaagcctcaaacaaacttagaaaatcctcctaagatttcaagggaaaacagtggggaagaaacacacactagagtgatgtttttctgtatgccagcgagtgagaaagagacttttaccataaaccaagtacaaaagatggtgaaagcctaagatgcgagagagagagcccacccaccgggtgttcacgagatccctgcccaggtccacggcaccgggaccgtcccagcccctgcccggcacgtgccttctcgcgcctctcacgtgacatccagcatcgaccgaagagacaggcaggcaggcgagcgactgggccagcgtctgccccccagtcaagaggagtcaacggtcaaccgtcgcggtcaaagtcaaagtttccgaccgtcctggtccgaattgaatggatccaacggtccttgcggccccatctcgatcgaatcttcccttgtatgatctcccaccattaaagcgggcggcgggtgcaccaaccggaccgcccactgtaactgccgtcgctgtgctgtctccacatgcactctcggagggcaataacagtacaaggagagatatatgcatacatcccaccgcaggaattgaatgctttcgatcgccacctctttgagttgaatgttcttcttgactcacaccagggtgttgttatgaatggtgtccttcttgtatcattcctatgggcacccatctcaccgaagctataaagaagcgttgcattaatgttcgtgcacatgtagtcatgcagtagttgcacatgtacgtaatatgcaaaatgagtgcacataagccactgagttcaccgttttttttaaaaaaatatttgcattatcttctagtgtttctttttttggtaaaccatttttggatggagaattctaagaagttgaacacaaggaaaggtggtcttgcatgaaggtcgagaaagtttatgggcattacctcttttatccgaataatacaattcatattaattgttagggggatgttactgtgatgtctggcatggccacagtaatcatataaaccctgtaattctttgatccaaccatgcatgcatgcatttcagataaagaaattataaaaaaaaaaggtggataattaaagtaatctttttctttgtaaaaatattattgtaccatttcttttgttcttgagcaggtaaatattgtggttactgacttctcatttcagtttggtgttaagtcggaagagacacgagcagatttgagagtggtttttctggtacattgccatattgtctttatagggcaacctcatttgaccagattaatgaaaatttctctccacaatacttttctttgtacatttagatatttatgaattcaataaatttataaatatgaacatcagtagaaaagcatggttaatattggagtgacattctaggtaaaaacatcgtatggttctaagtggtaagagataataatgaaaatttagattattattcctataagattctttaattgtctgcatgtacacatccatctctatatagaaatatgaaatcattaacatgaatatattttaatacaccaattcgacactactctttttctttgataagaagcaattctatgctatatgacatcatatcggactaacacatattgccggttctaatagcatgtgggccatgcatgcacattgcgtagtagaaaaaattggatgaaacgtgccgtatcgagaacctactaatgctgtgataggaatcaaatttattgatgatggctattggtcatgcaataaacactctctttattttttctaacggttgatgctgcataaattaaatatgttgtgcttgttaaaaaggagagggggtgggggttagaataaaagcatagatagcatgattttagactaatatgtggctaagacgataaatttattgttaaatttctaacattttgcctatttgcgattcatgccttgatgggtaaaagaaaattgtgatttttttgcgtgtaaaatgtaggttaaaatcatacaagtagtgaaaccggtcctataattagtacttacttgatctgcaaacggtctgtctctttttgattgaataggaggctgaggaattaaagctcagccacctgaagttttattaaaaggacaggagagacatttacagcacaaaaaggccaactcggctgagggccttctcttcttattaccttttacctttagctactaactggctgggcctgttgcaagagcttcagatggagagagagagaccatagttccttgtgacaaacggtcagaacttaagaaatactttgcgcgttttctagagacatatagttcaaatggcgtcattgacctgacagtcaatgatattacccacttttgtgctcttatcccagtattgtgtgaagtgcgggatgagacagagagcaccgagatagaggcatggtaaggtttcttgcgtggaatcacactttgtccagggtttcttgtaataaacttggattttcagaaagggggtccagccttcagaactctattaattatagtaaaaatacttcactcctgacgttgtaccgctagaaaagtttctcttattatttttttctacctttcgtttttgactctcaggagggagagagacaaagccccaccagcttttattaaggtggaggtgaattaaaaaagatagcatcatgaaacaccgtatgggatttggctccgtaggattttacgaatgagatctgtccaaggtaacaggtaatagttgtgaagttattgaaaagttcttgaaatacatcatttttttttgctcagcccactgattctctgaattttactctaacaacaacttagccgatggttatttaacaattcatagaagctataatttactcatgtctggtgcaagaacaacttagccgatggttatttgacaattcatagaagctataatttactcatgtctggtgcaagaaaggtacttaagaaccataccttatttatattgtgtgtcccagctgatgatggtgttttacatgaagaaataaataattaattgttcaatatgatacatcaattaattagctagcttacattattcatatatttaatagttttttcctaagttttagctttttgagttggtgctgacttttagaaggtcacagcattttttttccaaattgtggatctttagattagtcaagttgttctcaaattaatgccaaatttgtgactctaaacccatttgattaggtggagagtataaaaaaaaaaaaaatactggaccaatgttctgttaagtagcgacatagcatctgcacttttagaaacttgcaatatatatatatatgaagattaatatcctacttttatgattaccaaatgattttgaatttgacaacttacaaactatggctttggataacggggaagaggaagtgaaacgaggagcatatgctttacactccactcacaagaatcctattagacgggaacagaggaagcaaaaaaaaaaaaaaaaagagtataggttctatattcgatccactagaacacgaataaagagagtgaaagcaaagatcattttgaatattttttcttttatatatagaaaaacgaacaagaccaaaaacaatatatacctaatgtactatattattttggtgaaaaggaaaatattattataaactgcacattgatgagttcctatggtgatataataacgttataaatatatattatttatgaataatacaaaatatagatagccttatatattgctatttatcataatgatacagttatgtatgatgcatgtcctaactaccagttaattttcttgtactcatgacactataccaagactccgagatcactgcaccatggaagaccatacctagaagaaagcacatgcatgtatatatatgtatatataataacattgactttggaccataggtagtgcacatgttgttcaagagtttatttttaatataaaatagataagtaagatagtgtggtgatgattgatgccggagcatctagggttgatctggtggatgagtgggtttgggtcccatgatgggtgctaccctacattaggcaccaattagctatttaggaaactttatattagtgaactttaggaaattttgattttaagatttttgtttttgagaacttgtgatgtcatttggaaggttaaagactagagttatttgagttataataagatcaggaatcctatattagcaaggagaagaaaagggttaattctcttatacgacttataaatatctcattgaggatcctattgcgatcatctttgagtaattgcgtcatgaaattctgctttgaaaattattctttttgtgctcttttttctattccctctctcctctcttttggttgattcttaaggtttgcgagtaatggtgtgaaagctgtatctttggagtgcttggacaagatggtaatttggctgtggaagagagagacctgctatgcctcctccaacaatcaattttgtcgatatcctttttgtctctcttatttcaaaaccaagttcaactataatgattttggatccactaattaactcggtgccatcatatttactgttaccaacttgacaagtgggatgaagcgaatcggctttttttttcagccagcctcaaaggttggattttctagttcagacatccttcgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacaaggcaaatagtctggcttaacccgcaacattttgatgatgttcatgtctttccatatatatctgcttgatcttgcaaatggagattcatttaccagtaccaggatgaagataaagatgccagttcaagaacattcattgtcattacaatattctgacctagttctccatcatcatataatagagtcaactccaaaggccataggttctgctgaattatggaaggtgcatctatgcaaggaccatagcattggtgttggctactactgtactacaataatttagaaatcacaaaattttctttttagtcattaatttcttaccaaatcatcatttttaaatttttgaacaataatttttcaatcttttattacgaaaaagattgtaatgtttcgtcacaaaatgtatttgtttttttgaaaaccttttttcggtcattaaaatttttagccataaggtcgtcaaaatttttggtcaatataaacttctaatgacaaaactaaaagtttctgtgatggaattttcatcattaaaaatctaaatttcaatagtgttgttcatggtctatctagtcctggtcggctagctatcagaaccatatgcagtcctctgggaactaccttgatggccccgaggattctctgctagcagcttgcccccgggatccaagagataaggtagcctttcctccattaaattgccttcagtattcgattgtacacaaagttatagacttcacccttgacgtccagaagatccaggacttggtgccagaaggcactttgcggcgccgaaatttatgatggcgtcctcatgcgtaacgtgaaaagtttccacggcttacatgggcggagaagaagatgcatggaattttgacgataaagtcatgatcctatgacgccaaggttttacgaagatgtgctttgaagagattgaacagatggcactcgtcaaatatggagctagggctcccaaaatgaaggaagaatctgatgaatattaatattgtattccatggcgttataaacgggtgtaccaagaaggattaattatttttttaaggatgagaaatctttagttatgacccacaggctggtgaggtgctgatagatggtgtcaagctgaagactctcaagggaagattggaatggttaacacgcattccctctggtctgatgctactatctaggagaacattgcgtacgggaaggaaggtgcaacactggaaatattaggagacctctcttgagcttgcaaatgctgactgcccggttcattgacgtgatgccggaaggccttgatacggtggttggtcatgagcacggagtgtagctccctcgtggacagaaacagaggattccaattccgagagctattttaaaggatccaagatcatagttatcttaggacctatttttttatgaataaatattataaaaaaattatttaattttttattgatcaacttattcataaattattttttatagatcgatagcatttatccataaaatgaaaaaaaatcttatccatctagatggtggctaaattatttttccatcaatcagataaatatcctttttgattaatttccaatatacccttaaacttataattataatataatataatatattataataaatataaaatattattatatataataatatttatatgttattgttgtgggggttatcacacctcaactcataagaaagccgatctgaattgaaggttgagttcatataaaaccgatctaaattggaggctgagttcataagaaagtcgatctgaattggaagttgagttcataagaaagtcgatctaaattgaaaattgagttcatataaaaccgacctgaattggaggctgaatattgatctgaattggaggctgaatgctgacctgactcaactcagcttatctaaataccgaccttagctacctgaattgacttctgatgaagtatcatcatctgtttatatatataccgacctgattcatctcaactcatataaatactgacttgactcattttagctcatataaataccgacatgaagcagagtattacatatatccgagatgttcagggtcccatatgatacttgatttcatcccagtattttaccgaggtgaactactatattgacggccacagtcatcttgttaaagtccgctatgatctctacaactaagctacaactggctacgatctcacgtacaactgtgctataactcatccccaactggcatatacagctaagtatgatctcatttctagctaatatatgcagtaatactctagcttacttacagctggcctccaacggcctaacaaactctatagctggcctctaacggcctaacaaactcttccaacagtctcatcagtccctctataaataaagggcaaagggatccttcaggtaagtttttatttccaagtccaaagctcaaactagagggacactttgctgctgagactctagctcccacaaagtcataaaccctctagttctatacaaatcctcctgctctctattctactttttctatcttctattctcgaggctcaaattgacttaagcatcagagggtcaaagatcggagaatccccactaatttttgtcttattttgtaggattcttcgaaggagactcatattggatcaccacagcctctccaacatgacttcatccaatctcttcatctgagattttgagcctcacaacaatagattggtgctagaggaagagtgatctaaaaattttatgaaaaaaatggtgaatcaaaaagcacaaagcaactctatactttgaccgtctccctctgaagatatgctggaagctgtctcacctccatttgaaaggagattggggggtaggtgaaaattttttttttaaaagacagcgcactaacgataaactttcaataatttttttttaattttttaattcctatccataggagctcaaatccttttgtctagtcttatcaggttaaatcactttactacaccactctcagagccttaagctgtcaactcatggtattaatggggacggcccccacatcctgtgaggtgacaatactcatcaattcagaaaatcaaagggccagactcggtgctcaagaatattatgaggggcaaaaatatcctttccgaccatcttttttttcaaagctcttaaacaaaactcataacctctccgataataaattctcaagctctatctactattttattcttttgttgcaggtcaacaggttcttgagtacacgaactaaagaaaaaatcaaaacaagaataaaaaaatttatccaaacgagatatctatttgaggaaactcaagatgcgatttgagattttaagacaatatacctttgaaaagaaaaagaggagaaaatccccggacatagccgaagtcatcttacaggtgacaacaacaaaaaaaagggggagagagaaagaaaatgaaagagaggaaagaaggcagaggagggtcggttccctccacccaaggtcattcgcacaccccatcggatcggcatcttcgacactcccgtgcgcctcctggagccaagaatagccgatcggccacgtctcctggagccatgaatggcggaccagcctttcccgatgtctcccacactcctgtgcggctccaagtgccaaaacatcgtcagatcagtgacttccctccgatcgagaccatccgcatgctcgtgtacgtttgcagcaccaggccctaccaaattggtaactacggtggtctccacttcctttcttgcgctccgatgctccacacgaggcccagcactggcaaatcgatctccaatcctgcatcctgatggtgggctccactggattgacggcccccgatgatctccagctctcctccctgtgtcacgcatatttttgatcgacagtcccactatctctggctctccttcctacatctgtgggtattttcggtgccgaatccagtcagatcgattgccctccggcatcaaacatcgcaagatcggcactctctcgagttgccgtgctcctccggcatcaagcaccattggatcggtgcaatctcgagctgccacgcacctgccacatcaaatcgtgtcagactggtagttttccaaactcccatgcacctcctgacgtcaaacttgctcgaccgagatctctcggacaatcatggaatgtcattccaactccatttgcagtagtcaataaaagaatatgagagtgccatccagaacctgcaatggggccaaatagaagatttacttcatgaattgatgaatttttgtaatgacatacgcgtgcagtctaccctccgctcgaagtctgcacatgtatgcaatcttggacaatgccgaagagacccatgggtgtccccaaagcccaggccaaaattgattccaaaaaaaaaaaagaaaaaaaagaagaggagagagcttgatctccagccaaagttaaagtgatccaaagtactgatcaagcttgaaccaaacaacaagcagtcaagtagaactcgcaagttctcaaacaacaactcctggtaaaagattcttaagcttccatttgttattctttctcttttccttcttgcaggatcaaaggagaaaaatagagccaagccaaaatcaaaatcatgagcgaatcaaggtcaaaatcagtctaacataaagcaaaaataagctcgaattgagataaaacttaagtccaagctgcggcaaagaataggaaggagtcaaatataactcagaagctctcaagtagaacttataactttcatggtaataaactctcaagccccatctactattctatttttttttacaggacaacaggttcttgaatacatgaggcaaaataaaaataaacaaagtcataatgaatgtcaagcccaaagataaggtgaagactaagttaaggtaaagacagcttgatatctgacctcatcaaaaggccgatctcaattgaagtcagatatctgatctcatcaaaatgccgacctcaactaaaggcagagtaaatctgagctcatcaaaaagccgacctcattagaatgatgaaggctgagctcatgaaaaagctggcctcaacagaaagattaatagtggctcatcagaaagtctagcttatgaaaaagccgacctcaacagaaaggcttaacagatatttatcagaaagtgagacacccaatctccagattagatctcctcaaaattcaatattcggattggtagagcctcgagaggtacaaatggagataagatctcctcaaaattcaaactctagattggtagagctccgagaggcataaatggagataagatctcctcaaaatctaatctccgaattggtagagtctcgaagggccaaaatgataataagatctcctcaaatccaatcttcggattggtggagtcccgaaaagcacaagtagagataagatctcccaaatatcgatctacagatcgagattatcttcagttctataaaagtctaatctaaaggtcaagattattttggatttctatcaaataccgacttcaagtcaaagttatatcaaaattctataaaataccaacttgagggtcgaagttatctttcagttctataaaataaagacctaaaggtcgagattatcttaaatttttatcaaataccgatctcaaatcgaagttaacttgaaattctataaaataccgatctgagggtcgaggttatctttaagttctgtaaaataaaaacttgaaagtcaaagttatcattcagttctatcaagtaccgatctgaggatcaaggttatctttcagttctataaaatattgatatgaagtcgagattattttttagttctataaaatactgacctgaaggtcgaagttatcttttagttctgtaaaataccgacttgaaggtcgagattatctttcagttctatcaaataccgatctgaaggtcgagattatatttcagttctataaaatatcgatctaaagatctagattatctttcatttctatgaaataccgatctgaaggtcgatgttaacatacagttctatgaaatactaatctgaagatcaaggttatctttcatttctataaaatatcgatctgaaggtcgatgttatattttaattctataaaatactgatctaaagatcgaggttatcattcagttctttcaaatactgatatgagggtcgaggttctcttttaattctataaaatatcgatctgaaggtttagattatcatttaattctataaaatactaatatgagggtcaagattatctttcagttctataaaatattaatatgaatgtcgaggttatcatttagttctatcaaatactaacctgaaggttgtgattgtcttttagttctataaaatatcaatctgaagatcaagattatatttcagttctatcaaatacagaatctgaaaatcgatgttatcattcagttctatcaaataccgatccgaaagttgaggttatcttttatttctataaaataccgatctgaagatcgaggttatattttagttctataaaatatcgatctgaaggtggagattgtcattcagttctatcaaatatggatttgagggtcgaggttatatttcaattttataaaataccaacttaaagatcgaggttatctttcaattctataaaatatcaacttgaaggtcgagattatctttcagttctgtaaaatatcgatctgaaggttgagattatcattcagttctatcaaataccgatatgagtattgaggttatctttcaattctataaaatatcgatctgaaggtcgaggttatttttcagttctataaaataccgatttgaagatcgagattatctttcaattctatcaaatactgaccttaagatggaggttatcttgaaaatatcaacctgagggtcaaagttatatttcagctcatataaatactgacctcatagtcgagattatctttcagcttatataaataccgacctcatggtcgaggttatcttgaaaattactgacctatggatcaaggttatcttggatttctatcagatttcagcctcaaggtcaaggttatatttcaactcatataaataccgactttatgattgaagatatctttttagctctacaaaatatcaatctcaaggttgaggttttactgacctcaagattaaggttatcctgcaaaatacagatctatccatacttgaaattctgaaaatctttgaaggtattatcaatgaaaaatgctccaatgagtttactcttacacattatcttctaatctatgaaaattcaatctccagattgatagagccccaaagggcacaaatggagataagatctctcaaaatccaatctccagattggtagagctccgaaagacacaaacaaagatcagatctctcaaatatcaatctatggatcgatattatctttcagctcgtatagatactagtcgaccttagggtcgaagttattttattattctatcaaatgtagatctccagattaaagttatcttaaaattctattattgatctccagatcgaagttatcttgaaattctattatcgatcttcgaattgaagttatcttgaagttctattaaatatcgatcttcggatcgaggatatcttccaatctactcaagattacgagcaattcacttaaaaaatcaaatggtccaaattcgccacctcgaacaaactgaaaatttatttcttgggctacttcttttgtccaaaataattttttgagatcagaagtggggggcaagtgttatgggggttatctcatctcagctcataagaaagccgacgtgaatcaaaggccaagtttacataaagtcgatctgaattagaggctgagttcatataaagtcgatctgaaccagagattgagttcatataaagtcgatctgaattagagactgagttcatataaagccgatctgaaccagaggctgagttcatataaagccgacctgaattggaggctgagttcataagaaagccgatctgaattgaaggctgagttcataagaaaattgacctgaattggaggctgagttcatataaaatcgacctgaattagaagctgaatgccaatctaaattggaggctaaatgctgatttggcttaacccagctcatctaaacaccgatctaagctacctaaattgatttttggtgaagtattataatcagcttatatatataccaacctgactcatctcagctcatatatatactgacctgattcatctcagctcatataaataccgatctgactcatttcagctcatataaataccgacttgaagtagagtattacatatatccaagatgttcagggtcccatatgatacttgatttcattttggtattttatcgaggtgaactattatattgatgatcacagtcatcctgttaaagtccgtcatgatctctacaactaaactacaactgaccacgatctcatatacaattgtgctacaatttatccccaactggcacatatatctaagtatgacctcatttctagctaatatatacagctatgctgtagctcacttacagtttgctttcaacggcttaacaaactctacagctggcttctaacggcttaacaaattcttccaatggcctcatcagtccttttataaatagagggccaaagaattttccagataagttctgactcttatgtcccaagctcaaactagagggatactctatcactgagaatctagctcccacaaagtcacaaactctctaatttcatataaatccttcttctctctgttttactttttcatcttctattctcaaggctcaaactgacttaagcatcagagggtcaaaaatcggaggatccatatatactgatttttattttgttttgcaggattcttcgaaggagactcggattggatcatctcagcctctcctgcatgacttcatccaatctctccgtctgagattttgagcctcatagcaacaataataatataatataatataatataatataatataatataatatatatatatatatatatatatatatatatatatatatatatatatatatatatatatatatatatatatatatatatatatatatatatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtaaagcttgttaccatattacaattatttttctctttgcaaagcttgtgagaatgagagaaaaggttgccatatttctattattattttctctttgtaaagcttgtgagagagagagggttaccatgcatgcatatttcaattattatgagagagagagaagcttaccatatttcaattatttttctctttgtaaagctaatgagagagaaagagggttaccatatttccattatttttctctttgtaaagcttatgagagagagagagaaagggttaccaaatttcgattatttgtaaagcaaatgagagagagaaggtgtcacatgaagcagggtcatcttggccgccagaatggtcccggccacgagatccacttgcttggccccatcagtctccttccaccacatgcttggggggaaaataaaaaatcaaaaactatccttttagcagacgacgaggtggtttagctcttcatgggaataataacaaattgtttctaaccagagggaaaaataaaataaaaataatttttattcgtaatagtatatatgctttttagaaaaaaaaaatctttagatcagtacaaaaattgaacccccccccaccccacacacacaaacaaacatatataatacataaatatgaaatcaaacacaatcgatatcatataaacataaaaaaattcaaagttaaaaatataaaaattataataattacataaatattatatatcataatataatataaacgtgaaatacttcttcaagaataactttggaagcttggttgagtttaccaaacagctctaaaagctccatcagttaataagttggatcgcaaagtttaggatcaaatcattcataatatatcaaagcaaccagaaatcctactggttcggtccaattgctgttatgcatattggattgccatgttaaaaatacccttgtattctgcttaatataaacttatctcacaatcatttttcagtaaattaacaatgataatatgtaggggtaatcagaagaaatgaaagatgtgtcggtactctggtgtcatgcatatagaaatttttttatttattcatttaatatttttttatctatttttattcaaaaaaaatatttttatttgtttattattctatttttctctgctccatggtccccaactaggattagggtttgtgctcttggagccttctatttaataaacttatcttgccaggagtcataaataaggtcggtttgactctctcaacatattcgtcagtaatctgataccgaggctgacaattgtatgagaactggtgttataacatggacagatgctgaagtggattactaactctccctctgggctgccttttcctcgttggaacggaaacagtgttgggatttttggggaggtcatctcaactcttaaccaaggagacaggtatggggtcccccagggggggcccaaaaaaatcttcagagaattcggtggtggttactggtgacctcgttctcaaatcccttgtctatcattgccatcgtccttattaccaacttggctgacactgatatggtgcattcgcccaagtcaccgaagtcactacattggtttcttctaagcaggtagatgcatccctagttgccttaattttctgcaatgagttgctttatgaagtcaatgcatgacatcaacagttgattattgagaagaacaccaacgcaatcataggaacataacacaaattctctacattctctctctctctctctacaaaaaaaaaaaaaaagcaatttcactaagttcaaagacgtacagaattaccaaaaattttgcgaccatttagttcttctttcagtataatttctggactgcatttggtaatataatattaatataaatgttgatatatgtgtagatattttcatcttatctcaaactttctggactatatatgaaacaaacttgaacctaaacatggtgcctcttgcaagttgatgaaagccaaattgactagcattattggtgataaaagcatgaactcttacaccatgcactcgatcctgattaccagttctaaaagtagtggccaagtctagtcaattgctagcctgtaaggttgttagttttaggaccacccagtgtatgccaaccgacatgccacgaccaatgggctaatcttaaggatttgatgtgataccaaaaatgtcacgccaccactcccctctaatttaacatctttaatggttcaactatggcataagcggctagtttttttaatatacaatattaacattactttcttagtgtatgcatgcaaggataagtatttattgccgatggcttacgtacgttatcttgatgccacaaactgtagcgaatgatgttggttgtctttctttttttcttttttttttttttcatttttaatcatgtagatccggtaaccaacttaatttatatccttagctagtaacatttaccaaagtagtgtatcgatacagctagtttaaacaaaaattagacctgaattaattggattcaaccatggtgatccctccccctcacatgcatcgcagcatattaggcagcattttttttggcatccaagcaagttagctatgtgtgcaaattaataagcttagaacaaggcaatgattcctctacagcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaaataaatttcttcctatataaatcagagttttcattgattcacaactaatgtaattaagattaacgatgcccttcttctacaccataatatagtcttctcctaatttttatcataattagtatacgaactggagagagttccatggttatagaaatgattctttatttggagtgtcactattgcgatcaagagctcacaattcgacatatcagatattgtctattttgactcatgaattttatgatttattttttaaaaatattttatttgaaaaagatgattctttttttatataaatcaaaaaaaaattaactcataattaatataaaattaataatatattttttttatatcactaacaaaaatattttgagatctgtgcagtgtgagatggccaacgctgtggaacaagcttagttgtcctttggggcaaaagattcagcccgaacctataagagagaagggtttacttagaaggtcatctttgacaggacccacagaaaggagtcacggggttcacttgattccacagttatcgtaccctagtctacagtagaaatcgggattcatctcacttccccatccgaagttccaactaaactctgacaggtgtcaatcccttgagcatcatgcaaggcattccgaaacaaggcatcctacatgggatcgagattccatgtggaaagaacatgcatgaatgcatgcatgtatgggagttggtcttttgggaagtggtggctggcgagggagggaaagactacagtgaattgaaaaaaagagaatttattaggggtcaacagagtaacaagagtcgtctgaatagagtaccatgctccattttcaaaagaaaagagaggacataaataaaaaaaaaaaaaaaaattaactggccgaaaatatgccaagaaggagagaggatgggtggaaaccaaagtggatgagaggaccaatcgccacttaagaggctaccgccaacatgtcctcccattatgaggtctctttctcatctttaactcctcctccatgcacccctcccttcatgtaggccctccccaagctatgagagccttatttaacccctcctttccattcttctccactccatggtgttgtgtagagaggtagattaatgaggataagagagagcaatcatagtggtactggtagcgctcaagtagtaatcacaattaatactcgtatcgatcttggtattgtgcaagtttaacaacttcttccatcttccccaccacttgcaccccttcaacaggaagaaccacttattggacagaagtatttatagggtaggagagagggtgaagggggtgatgattccatagctcaccagtttatggcaattatagcagccatgagtgcaaacgacggcaaggatgatcacgagcacgaccttgtcatgcccggctttcgcttccaccctactgaggaggagcttatcgagttctacctcaggcgcaaggttgagggcaaacgcttcaacgtcgagctcataaccttcctcgatctctatcgctacgacccgtgggagcttcctggtttgccactccacttcctttttcccttagaaccatctcttctctcttcccttcaactcttttgtctttttatttttgcttttttgttcatctttgatgcgtagtagacacaacttttttgagaattggtcgtatcgtatatgtgaaacctttagtttattaattgatcttctctttgctttcttgtgaacgatatggaattttgatgacagcattggctgcaattggggagaaggaatggttcttttatgtccctagagatcgaaagtatagaaatggtgatcggcccaatcgggtgacgacatcgggctactggaaggctaccggagctgacaggatgatcagagctgagaatcaccggtcaattggattgaagaagacgcttgtcttctactctgggaaagctcctaaaggcatacgatcaagctggatcatgaacgaataccgtttgccacagaacgagacaaatcgatatcagaaggtaaactggagaaagttaggtattcaaattattcatcagttccaagtcttgtaaggtaggaggtaggggtgaggagaattgaaggaaacttctaattttctggttatttagagcactggcgaggcatgagtcagtagataatcaaaaatttctcttctttcatttctgacccaaaaaaagggagttcttcatcctatttttccttctatataatcttccatcaaactcaaatatatgcagcattctagttgtagtcccaaaaattatgttgaggtcggacatgaaccgctgacggcaagttagggtttccacatattttttctccaagtttattttcttgtagtttttttttttttgacaaaaatcttttggttttgtgaatgtaagtttaatttcctcctggccttgctactcaattaacatggacctgttgctcaagttgtcgccacatacttttctgaaacaatagttagataaaataaaaagtctctcttcggtcttgtttctattttatctacatgattctctttccactttgtgatcctttttttcttgagctagcttttcatatctgatgttttctcttaagtcaacaagaaggattagacttaacaataacaaacaaaaaagggaggaggagaagaacaaggccttgtcaaatttctcctccttcgtagtaagtttcttctttgtcttctccaagtcagaaggtttgccccataaaatctgcttttctgcaaagtatgcattttgttttggatttttctgttgctctttgtgaaccaagcttactgttttaaatttcttcttcttcatcatgtcgtctctttctcctcctcctccttctccttggtctgcatgtcctgttcctcctcttattcccttcttcttctctccttctcttcctcctctacttcttctacttctccttctccttctccccctcttcttattctcttcctcctcttcgtccttttcttcttctagtgctgctgctgctatagcttccttgagctcttcttcctcctcctcctcctcctccttctactttcacacctgcagtttggttttatgcgttaacattggtttagtaacaaagcctcatgctccctcgtcttctttctacttttctttcttgttgtgcagttctgattgggatttttcctttgcagaccgaaatctcgctctgccgagtctataaaagagctggggtcgatgaccactgtccccagggcttgctcccttccaaggcatcctcatctagagggactggaccagataagagacacagttcctcccatcagccaccaccaagcttccaaacgtttgcaggaaacatctcgtcgccaatgatggagaaggcacacaaaatgggaggtggaagcaacgcccacatgtcggcaccgccgccccacaaacctactctctatggatcgacggcttcggtggcttcattgagctcgactacgtccactgaagaagatggtacaacaattcatccgaagaatatgaacgctttaatcccaacatgttccctcctcacttctgctacttcctccatggccagtcctacgatggacgagctcatgaataggttagtaggttgcaaccaaaactacacgaaccaacaacccaaccaattcctcccattgccaccgcaaccccagttgcttcctctcaacactctgcccgtttcatttccaaccatttcagacaagctctgggagtggaatcccctccatgaggttgctagggattacaccagttttaagtgatcgatggcgtgctcatacacttatatatatatatatatatgctcgctgatccattgtcctcctcatatttttcttttcttttcttttccaacaaagactgctgaagtatgtaactgtgggtgaaaacttattctagatcaggtttgtagttcgactaagtttctataagtttgcatggctattgttatcatgtgtcgagttttattcttcttggatatatactccaaatctatgttataattttgggaggatggtaaggaagaaggaactttcttttgagattattattccatcatttgacttctgaacataaaataatgatgccgtggtttgttgaagacttgcagagagagctgtctgcagggagtttggatatgaatgcgagtaccattacgggcatgtgattgcggcattgtcttttctttgggtggtaggactaatcaaactcaagtgagcattctgttaagtctgtctgtagctgaagtcatggaggatgatagattttttagataggattgaggggtggatcctatcactgaaattttaaacttctcttattcatatatacgttctcatcaatgaatttagggcattttatcatcttctagggtctcttttggtttggcatgtatttcctaaactggaaatatttcagatcagtagttgtgagaggagattcttagtctatatgtggtatggtcttgcactccctttcacttcctcgccaatagattaaaatgtctgagatgtgggcattttatcatcttccaggggttaaaatttcttgtctttgcatgcgtattctaatctggaagatatttaatttagagacatcacattttatcgtcttccgtgatgttttactgtttggcatctacttgtggcggtcaggtagtatctcagattggaagtcacgagaggaggttacggcctagctatgtatagatctggcgttgcttctcactttgttcactttctcaccaatgatttaaactgtctgatatatggaccctttttgtcatctcaagagcttaaactttctccatctttcatatctcttctaatctggaagacattttaggttagtacttaagaaaggagctcaaataggctatgttgttgagctatcttattttgaagctactcttgcactcatttcacttgttctcaccttaaaatgacttgggataatagcacttgaccatcttctgaagtcctttcttaacttggatatcgttttcttctttgggcagtgttttagatttcttttgaaagctatagccttgacattttatttcactttacatgttctcaccaataagagtttaactagtatgtctctgatagaagtattaattaatatataatcttctagaactttcacttcttttggttccagatgtcttgctgagcttgggcaatctcttaggttagtagccatgataggggttggaaactagatacatctgagctggcatcatgttcttgcgcatgcctaagaagtgtacaaattaacaatgtgatctggtccaagttttcagtccaagaatgcatgagctgtctgtgtgccctaaaggtaacacttggatgtggagattttgtaagcacctcaaccaactccacttctagccttaggccccctatatatattttatcatacaacttgttatgtgtcttaatccaaaataagccatgacacaaatgtgtgcattatcggtaatgactttcaaagattgcgacgatcgataaatctgttctagaccatgttcactcactcttactgtgaaatcttttcctcagctcatggttttgattttgaggtatttccaagtttccataccagaagtatagaagtcaaatgcaacactagagtttcatggcttctttaaatcttttagccaagaacaaattagctaaagtattagttagatcctctcattaaaatatatcgacgaagaatggctttcggagaaagctgatctacttcacatgaactttcatttatgatcatctgatccaggtccaacagtgaaaagaataaattattttctaaaaaaattaagctaggacaacagaaagagtatatatgactgtaaaactctcaattagtgagattacttcatatatataagattgttataatgtgttcactcatggtgagtttggttatactttttgatttctaatttttgatttttaaaaaaatatttttatttttttatttttattattgagtaaaaataaaaaatatgtttagtaactacgttgctataaagcaaaaagcaacatttacggatggcagatgaagaacttgacaaaggagaaaagttcgaaaagagagagagaaaggagtggagaggtgaagagctcgacgagggagaagggttcacgctctttactttttgatttgacattttatatatgagaaagtaaaaaaaaaaaaaatagaaaagcaagttttggaaaacaaaaaatttttactttgtatataaaataattattttgatttttttattttgattttttatgatgttattaattttttttatttttattttttaaaattaaaaaaaaaaattaatggctaaacaaatgcacactcagttgctatccttaattgtccgagtattccgaccagaaaataatctagagaatggatggtttggtttctaatcctgccaccttttgttgcgagtccatctttattagctccatgaatcatgcactatcatcatgtcaatatttattattgtagataattaatgacttgttacaaaaaaataggagattttcacctaagtttgaaaaagatgaaaagagtatcagaaccaagaaaaaaatgaacgagtctctgaatttttagaatattttagaagaaggcaattttaatcagaaataaaaaaaaatcaaaaatttgcatgattatgaagcaactatttttcaaaacaactatttttgaagtaatagaaacaaaaaataacggttgaaatcagagattcagggccgagaggctgcttcacttcttcacctgttcaaaacaatacaggatattttcaactcacacatctaattgagcatattaaaatattagaatttttatggagattgcaggcatgtatggttcggggaagttagacaccagaaggcgaatagaaatgaatctcctattctaactgtttaattaagagactccatctctattctgatttccatagaaaatggtaatatcccaatctctcaaaactgaatttttattttttttttaaatttaaatttcattctgattctgcttataagtcagaagatatgaccgttctgattccaattctcgttgcaaaccaaactagctcagtgcaaaccaaacgcaccctgatagtttgttgccttggtactggaggtccagaaggcaatatatttaggattatcagatagacctttttaggcaacattgagctagacatccagagccatgagaactcacaggacggaaccaatccctcatctaaatcgccgcatgttcaatatgtgcaagttcagcctgctgaaaaattatatatgaaaatttaagcataataaaacaataaataccaaagaccatgaagggggataaaaggaaaaggtgtttagttacaattcatgcaaaagaatggatgcaggcgacaagtcaacaacagttgtgaacagcctttacgaaaactaggagtatttcatgattaggctgtgaattattcctgaatcattacaaattaataaattagtggatacatagcaacatattcatttgattgatgcacccaaaccacaacctccaaatgtggtttgatgctaaatgagcaggcaggttagccgttctaagaaaagagagtgaactatcttgtttaaaagagctgaatgtaaggaacctgcagtagattttggagctagacctgcaaccagatctactccaagtccaaataaggttggacagatcctggcccaagctcaacccgactgtttccaggtttgcacccaatttatttgattgatgacagagagagagagagacagggagagttttgtgggatatatcggttttatttggtaaatgctacctcattcaagagatgtaattggtcgatgatgtatataattataacatcaacaacagctgttgccatgccatacacatgtgagattaatgtgccatgccatacacctgtgagattaacagtggatagactcactagttacatttgtttggccaaggcccttgtcaggcactagtaactgctatatcctgcaacaaatgtcattccaaaacaagaattttccagctttcgcattctctgccacaagaaaaaattggtcttggttaaaaaaaaaaaatgcaattcatgtatggcaagtgacccccaatactttgcagcagtgcctgtttctttaaggcgcctcaataaatcaccagaagacctcaactcttgaatgctaatcaaccagtaacacttcatccaatcctctttttatctccaaaccacgtactttctgtctcattcaattgaaatcagcagcagctattacttggctcatgctcattatgtatcaatgatgttcatcaagagggttgaggaagaactttaagattcagcaaaaagaaaatgaccataaagaccataatgctcacagaaagaaagaatacttgatgttaatgaggatcgcatatataagcatgggtaatcacataaaatgttacatgatcttcaatgagaagtgctgactctgccagggtcgttaacaataaagtggaataaaacctaactcgcaactgaatgaatgatctaaaaacaatttaaattacctcatactgacaactttcttacgatcagcttcaagtgcttgcaccatgcactttgtgaaaaatcaaattttgggttccccagccatgtgttacaaggaaagtgaattttgaagagagggaaataaactaatatgatgattcaagacacacacaaaaaagaagaagaagaagaagaagaaaaagaacaagaacaagaagaaaaaggagaaaaacttgcactttgacaattaattgctccccataataaaatccaatctcattgtgctctagtccaattcagtagaaaagccataaagtgattgacagaaagaatgctgaagtaacaaataataagatttagaacaaactctgaatctctcatcatgtaaaaggaaactgatattcacaaacgatccacaagaccaaaaaatgaaccacttaattcataaggaaagcaagagtactctgtaaaaataatatatcattctatgacaaacatcttgaacttagcaaggtgcagtacatatacaatatgctccataaaattacaaaattaaatcctgtatgacaacaggcaaaacacagagagcctgaaatttgctgtttacaactcacattactaaatcactgtaacagctctcttttaagaacctaattgaaagagaacatttggagaggcaagttctccacatattttaattgaaataggttaaaattattggggaggcatgtattcagaacacaaaccaagtccgtagctgagagggaacagttgctagctctagatttgcaacaactcttatttaaggcaagcaaaaaccaagtaacatgttcttagggaaaaagtttccctcttccagatagtcccatttgggtccataccaaccatgtaactaggctatggaagggtagaccttgctctatacaaaagaaaatcggaaagacatacaaaaaggcagcatccctcaacatatttaagggttcaagcagaatgatagcaacagcaacccctgctatgagaactaaaaccaaggaaacaacctgccctcatgaggatgagttcagggtgtctgctagaggaaagaataaaaaaaaatccatctagaagtgcaaagatgtctatatgcaagaggaaatacagcaaccaaaaaatgtctgtcatacaatagaacatcatagtcaggttcccaagatggatggatgtgagaacgacattgccctgaactgaaaaggtatgaaagctaatgataaattatacacaagcttttgcttttcagtatcatgatgatgctttctccagataacaccatcatctctagcacacgaaggcattattcttgagcaagatgccacataggaagataatgccaaattctcaacatcaggagattcgtgtgcaccattcgacgagtttgataaactcagatggaagtccaaaaaaaaaaattcttagtggatgaaacaaaaatctgattaatgacacaaagtttatgcccaaggtgagagaggtcatttgtggacatgctaacaggaatctcggcccacaggaagcgaaggaccagatcccaaatttaatatcaaactcaacagaggtatcaaacaattatataaatatacattaaagtgctcagctaaaggcaattcataacttgtagagtcccacaagatgtcgtacaacagagattttttggtaagaaatgcaaatatctaatggttattgtgtggggcaaaaacatcaattgtgattctataatgtaatatcgctattgctaccaccaaaaacagaaatatcgacaataaaatgtcatacactgcaccttatgttggggatattcagtcaaccatgcatcattgttagatactagcctatttagccaagctacgagaccagatattaagcatgaagaacccacaccctcataccatcaatccattaaacaatctgataatttagctcaatctgctcatagttgaacaaaatagcatcccatgaccatcatagctttttccatactattaggcttaacctacagtagctaatatgccatgaccagtgttttgtcttaaaaacatttcatacatgactgcataaaaaagcttttaactgaaattccaaatgcaacaaagtgaataagaagaaaaaatgtgggaggaaaactaacataataggctgtataagctttaaagagaccctaagaaatattggtgaacatatatttagaaagatctttatgcatgataaagttaaacagatgctttggacttataatcataagtggttcatacattggctacacaaccatagccatttaggacacaagtactcatacacctcccaaactacattcagtgccaaattatgctatggtttgccataatggaacatgccatccagtgcacagcaaactgcaccattctaaagcgaacagatccttggaatgggtggcatatcgactaccaatcagtaccaaaaaccaactcgcattgacactgtgctaccatgatatggtgtgggtaccaaaacctgtcattcgaaccataacaccaacttattaggactccaaagctagagctcctctaagcattcctgggtgtggcatttgtcatgcagtggcatggaaaggaatgtccatcacatcagaaaaacttaaaattcaaggaaatgtagtatattggtcaaagtatcagaaaactttgggaaaagttggaaaataaaatagaacgagagaaaagatgcaagtacctatatatactgatatgtaagtgcacaaacatcagagagcatgagaggcacacacaaacacataacatccaataatacaatatatacattacatgaatgtccacattactgaagaaattactgagacagttttgaggctgaatccatctactatttaccaataaggacaaaaattctaaaaaagtaaaaggccaacctaatagttgcttcttgatcatagaaaacccaagagaacttcttccaaaattcaattcctacttgtcacagttccacagatgagtagataatccttagaatcataaaatactaagcatcatggtacattgcctgttcatcattacatattgcatatagaaatcaaccatactctaggaactccacattgtaaggcatccttaccgtgttagaatgagattttctcagaacaaaaatgatttctatcatagaaaaatcgtaccaaacttttttgtcaggttggtttgcattcaagaaaacaggttatgtttcataactgatagattcaaaacaacacaaaaaaagaaaaaaaaattctgccaatgaggataccatgacaaatcaatcaaactgtttgctaatgttctaaaaattgctttttaaaagatagatggtgaaaaacagcaactctttctgtgatcatatgtctattattgtatttctaagctcataatgtttactgaaacccctaggtttcttcccagaatgaaaacagaacagaaacaaataaatgtgaaaaaagaaaccctgccaactttgtctttttctatatggatcaataaggagtttcacaatcacaaatccaaaatgtgtggctataaagctcctgttgcatgcttggcatacatctcctgtgaactcacactttctcgagtactggaagtgaaactaacagcaagaagagtaaaaacttgaatttaaccgaagatgccaacactcttgggccctaggccttatttccatgtatgagatcagttccctgcagaaatttgtaaccagaccaattacagacatatcagggacatcaaaagccaagcatttatgatgaacagaatctaaaccaacctttaggcttaagcagttttctcaataactcaaacaaaaattcagtgacatcaatgtcaccagataaagatctgaaaaatatgcagaaaaggaaaattttagacaaaatattaaaaaataagttgacaaatcaataatggaagacataaaaaagtacctatttaggagcaccattcacgagcattctgaaacatccttaaccatggacttgggcctttcttgtcaacttcccattcctttggataccacgggaactgccatatcatgaagcaacgctctggatgtggcatcatagcaaggtgcctcccatcaggagaacaaagagctgcaactcccagaggcgaaccatttggattgaaaggatagacctctgttatgctgccagcatcattgcaataccgtagaggagctagattagacttaagaacacattctaggacgccattatcagggaaatatgctctcccctcaccatgagctgcccaaacacccaatgtagtgccctccattcctttgaacatgatggctggagagtccccaattctgacacttgtaaagcgacactcaaaacgaccagattcattatggataaaccttggttgtgacacatctccccccacaccaagggaacccccaatatcagccccaggtacccatccaaggagagccatgagctgacatccattacatactccaaggctgaatgtgtctggctgattgtagaactcttgaaattgccgtagaagaggctggttgaaccttatggatgctgaccatccttttgcagaatcgagaacatcagcataactgaaaccaccaacaaatgcgatcccacgaaactcatttaaagagattttccctctcagaaggtcagacattgtaatgtcccagggttcaaatcctgcagcatagaatgctgccgacatttccctatccccgttactcccttcctcacgaatgatagctaccttgggctttaaagttacagccattaccttctcatctgtgaacttgggagaaaaagacagtgtccatgaaggtgcttgtctgctttttaagccttctttctcaagtctcacacaggaagccaacctttggaacccctcgagctgaaagctagtctcctcccataagtccctaaggtaagatgtgtcctccttcagctgaagtattccatcaacagacaactcaatcactggtgatgcagtaactttaccaataacctcaccagaaatgcctgctgcttcaagcttttgcctgactgtatcactgttctgcgagctaacctcgataataagaccaagctcttctgcaaagagtatctggagaatattattaccctgggaattcaagttcaactgcacaccacaatttccagcaaaagccatttcaagaacacaaactataagcccgccatcactgatgtcatgaccagcagatattaatctttcactaagaagctcctgaatagtctcaaaaaccttcttcaggtaacgtacatcatcaaggtcagggcactcatcaccaatttggtcaaaagcctgggcaagagaagatccacctaaacgacgcttccctttagctagatcaatgtgcatcagaacaccaaaattttcaagcttcaaatctggagtcactgtcaatgttatatcaggacaggtaacataggcactgataaccaaacttccaggagccttgacaacctcaccacccacatgagctgccatagaaagactgtcctttcccccatctattgctatacccaattcaatcatagactcagagagtgcaactgcagcatcatacattgctgctccttccccatcaagctttgcagcatacatccagttaccactagctttgacatcactgagagatgtaactttggcccagactagattggtcaaggcctccccaacagccaaccttgccatagatttggggttcagcaaaccctttattggctgctccccaatggcacaagcaccaccagtcaagtctgtgtatgtctgtgcaataacagaaacatcagaaagtggaagttggagaggccccactgtttgctgctgtgccacaagacccgttacacacctgtcaacttttgttgttaagaagcgtttggagcaaactgaaggaagtgccaagactctctttaaagtctccattaatggggtgccaagggcaatatcaagtggctcttgcaccaaaggcatccgcttgaattcaaagcacttctgaggcatgtctccaagtactttttcaagctcaagatcctctacaggaggggggagagggagtccatttgactgacaatgctcgatagctgagctgtcaattaaaacaatacggccactgccactgatggtaccaatgactgccatagacactctttccctttcacagatggattctagtaagcttcgtttttcaggtttcactaacaatgcatcctgttcctggtactcagcaccccatatctctaaaactgacatggtctgatcacctactacgatagatcgaatatcaatttcagctccttgaggatcaattatttccttcacaacattacaatttcccccagctccctgatcatgaatactgatgatagggttgttttcccccatttcagtgcaagatcggatcacacgatacagcttctgtgccatctcagcatctcctcgttgtacggcattgaaatctagttctgcatcattctgcccactgaccatgcttgaagctgcaccacctcccataccaatccggtatgctggacctccaatcttcacaactagcatcccaacttctggctctcgttttgatatgtgagcatgatcaatctgtccaatccctccactaaacataattggcttcagccattcacgccgctctccatttgggagcctcattccaaaagtcctcgtgaagccctgaatcaaaggctctccaaacttgttcccatagtcagatgcaccatcacttgcatctattaatatctgtagaggaggagctaagtttgatggatatgagaaagttggatcttcccagggagcatatgagccttccatgtgaaggttaccaacacagtacccagctgtagaagctacaacaaaggaaccccttccagttgcatgtgtgtccctgatgcgacctccagcacctgtctccgccccaggataaggagccacagcacaagggaaattatgcgtctctgctgtgaacaagatatcaagctcacgcattaacaaggacaatggagatgtcgagccaggtgctaatggccgcaactgatttactgggaatcccttgattgcacttgagttgtccttgaagccaatgacagaattgttgggatttgccttcaaagtgcttttcacaatctgcatcaatgtcctgttcatcggtttgccatctataacaagtttcccattgaaaaaccagtgcctgctatgttcactattggactgtgcaatgtcaaagagttcaacatttgtcgggttgcgtttaaaatcatccctaaaaagtctggtgtaatactgaagatcctgttcatcaaatgcaagacccattttcaaatttatttcttccaatgcctctcttcccttctcaatgacaggaaccacactaatagcctctggaactgcattagtccgaaaagatgtgagcttctggggataaacacactctgtcattctatcctgaaccatagctgcaaaatcattaatttggctctcatctaatgggctgctgccagccttgagatacagaagatatcttcttgacctctccatgcgtgttacttctgtcaaggagcaagcttggcaaattgatacagcatttgctgaccatgctgtagtaaaggacatgcggggaccaacctcaactaaaacagcaacttcacctttgcagacctcctcctccagaaagctctctgtctttaaattctcaggttcataggtctcctgcagaagccacttaagtattgtgagcttgtcacctgataagacaccactcaatccaatgttgaagcactgctcggtccttaaatcaacgatctgaccagaaatctttgcctggaccttcctgaggagctctgcagcagcactgtcttgaatcagggggtgacggtagaagtgtatgatctcaggggactgttccaatgcatcagactcttcggccacttgactctgcaagcctctagaaaccactgctttcggtttcaacaagaatggggaacttgatgttatacttcttctaatatttaacacaggatgacttttgtggccaaagctgccgtgaatcacacgacacctccttggacaagaatttgtacgcagaagaagattaggcctccttgatccctggaatagataaagaagagattccagaacaattaacatagtacagcacacaagaacataatgcaagaacaggcattgtgggtgcctaccccataaatcaagaaaccgtgctgccgcaggaattcagtagcagcagtctctccaagtgcagccattagatcactgcaacaactaaaacatacatatatacaaccgtgattaattgctcatataacaaaaagatcaaatttttaattcaatttaaagatacccaaaccacatcaaatcacctcacaaatatatatatatatatatatatatatatataaatacgaaccaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttgcaatcgatttatcgatcaaaaaattaaataaattggttgctaagttttttaaaatattttttatttaaataattgataacaaaatcaatcataatttattttttataatattttaatttacaaaattggttgtaaaattaatcactaaatttattaaaaattattaaaatcaaattgatttgaaaatcagtctcaaaatcgatcgttaatttttaaaaatatttttattttaaaaaatcaatcataatatcgattgtaaattattttataatattttttaatattgattataaaattggttactaaatttgttaaaaattattaaaataaaattgatatcaaaattgattgttaattatttttaaatatttttattttaaaaaaattaatcataatatcagttgtaaattattttataatatcttttttaatattgattgtaaaatcgatcactaaatttttttaaattattaaactagaatcgatctcaaagtcgatcgctaatttctttaaaatattttttatttcaaaagttgatctcaaaatcaatcgtaaattttttataattttttatttttaacatcgatcacagaagtagttgctaaatttattaaaaattattaaataaaaatagatatgaaaatcgatctcaaaattgattgctaatatttttaaaatattcttgatttaataaattgattggaaaatctattgaaatttttttatattatttttattttttattttgatcacaaaattgatctcaaaatcaatcaaaaattattttaattaaaataatcgattgcaaaaatttaaatttaaaaaaataaattaaaattatattttttttgttacaaaaattataagctttattgaaatataacagaaccaagtaacatcatcatccttcatacacaaccaaataatatatcctaaacaacaaaataaaacagaaaaaaggccaaaatataaatcctctcgtgataaaaataaaacacaagatctacaatcacatagcctgaaaataccaaagataaataatatagatttaaaatagaaagcaataaaagaaaaagaggccatagtaatttatagagccattcccttcaatatccattaagtttagatcgtcatcagaaaaaataagaagacaactataagtatatagcaagaaaaatccatcggcacttatcaactttaacacatcatatgagaataagacaaagaggccatagcatacgtcgtaccgaatgtatcacttgtttaacatacttcatgccaaatgtatcataatcataagctgtctttatctttcttaaacaactcacccgatagactttccaaagtattacctgcagcaaaaataattgatactaacataatatatagagccaataagataataagagagagttatttttactttcaattataaagaactcctctactgtcagttaaaagcaaaattcatcaacatctatcagcttcaacacatcatatgggtacaaaaaaaagagaccatagcaatctgtgaaatcattcccttcaatatctattaaatttagatcatcatcaaagaacataagtaggcaactataagtatatagcaagaaaaattcatcgatacctcccaactttaacacatcatatgggaataagaaaacaaggctatagcaatctgtggagccatttccttcaatattaattaagtttggattatcatcaagaaaaataagaaggcacctataagaatatagcaagcgaagcctattgacatctatcagctttaagacatcatatggaaataagaaaaaaagaccatagcaatctgtaaagccattctcttcaatatccattaagtttagatcatcatcaaaaaaaataaatagacaaatataagtatatagcaaaaaaaatacatcagcactcatcaactttaacacatcatatggaaataaaaaaagaggccataataatctgtggagccattttcttcactattcattaagtttggatcatcattagagaaaataagaaggcagccataagattatagcaaataaaatctatcagtatccattagctttaacacatcatatgtgaacaaaaaaaaagggccatagcaatctatgaagccattctctttaatatccattaagtttagatcatcatcaaggaaaataagaaggcaaccataagtatatagcaagaaaaattcattgacacctatcagctttaacacatcatatgagaataaaaaaagagaccatagcatattttatgctaaatatattatttgtttagtatacttcgtgccaaatatatcataatcatgagctacctttatctttcttaaacaactcacctaacagactttccaaagtattatctgcagcaaaaatatttgatatcaacataatatatagagccagtgagataataggagagagttatttttgctttcgattataaagaactcctctgctgtcagctaaaaataaaattcgtcagcatccatcagctttaacacattatataggaataagaaaaagaggccatagcaatctgtaaagtcattcctctcaatatccattaaatttagatcactatcaaggaacataagtaggcaaccgcaagtatatagcaagaaaaatatatcgatacctatcagctttaatacatcatatgagaataagaaaaagaagccatagcaatctgtggatccattttctttaatattcattaagtttggatcatcatcaagaaaaataaaaagacaaccataagaatatagtaagtaaaatctattgacatccatcagctttggcatccattagctttaaggcatcatatagaaataaaaaaaagagactatagcaatttgtgaagccattctcttcaatatctattaagtttagatcatcattaggaaataaataggcaaccataagtatatagcaagaaaaatctattgacgccccattagctttaacacatcatatgagaataaaaaaaagagatcatagcaatatgtggagccattctctttaatatccattaagttttaatcatcatcagaaaaaataagtaggcaaccataacaatatagcaagcaaaatttatctgcacccatcagctttaacatattatgtgagaataagaaaaagaggttatggcatacctcatgccaaatgtatcacttgtgtaacatatctcatgccaaatatatcataatcacgaaccgcctttgtttttgttaggcagctcatccgatagatttttcaaagtattacctatagcaaaaataagtaatactgatataatatatagagctaatgaggtaataaaagtatcatttttacaatcgattataaagaatccctctgctatcagctaaaagcatgtcaaaaagctaaggtaataataatcagatattcacaaaatatgcattcatgtacaatcctcggcatagcatgaataaaacataaatctaaaaaaataggtagcaaaatctaatcactgttctcctcctcaatattatcatcatctctacctaggtttaaaggtgcatactatggtactggtgcctgataagtttgatatgaccgaaaaatgggtggctgcgaaggagatgattgaaaactaggagattcctgaaaactgtgagatggttgaaagtttatctttacaggaagctcacgcagtaacctattttttacatcaatctccttttcattatgttccaccctctttctaagtttatctctttcacgttcagcagcttccacccgagaattctattcagcttcaacttgccccttatttactcatgaatttcttgactttgcatctattctgagcatgatgaaacttagctatgaaaaatatgatgaatttgtcaatatagtagattctaatcctaggccataaatcctttctttcttctttccaccaactatgtgaactcacatatccaactctgatggcagaggctgttgagaatcagatactctctgagattatgcctccttcatattacgtcgaaattcatcctgtcaaatttgtctcaatttatataaagtaagtattaaaaataatatataatatattatttacactaatatgctctgatctcctatccatccaactcttatccttcttttgatgggtgtgcataaataattcagatagagaaggcacagcaccagtcttcactgtttgtaatattttaaaagatataaacatcaactcttatagaaactattataatttgtaactatgaaccaaatataattaataaaaaaaattagatttgaccacgttgtgcatatattgagaagtggtaatggagccaccagtgtgaagagaagcaccaaacccaccatactcagaagtacaattttgtttagctttttcatactttttttttatattgtacagtactccagtgttggcccaatctgtcccaaatagcatctccaatccaaagtggtctctccatattcttacgagtattaccaagtagatttttcaatcgagctgcaccatgcttttcaaaattttttcatacccattgatcattcggtggcacaaactgataccttctctgcaatatgaatatggacaaataaattaaataataaataaaaataaatagataataaattgatcacataaatatcattatttacgtaccttaagcttagtaaaccacatatctctaatagtgagagatatttttttttcatgatatcgaaggctcatcaaagtggctcctcataatttcaacaatggcatttgcgactgggtgagaagataagaacctataaatattataaattattagtcagtatagatcaaatatattcaacatgctaaagtgactatgatattctaaaataaagttatcacttactcatctccatcaaagtataacactggcatgccatcgctagtctgtgtctctgcaatattttgagaatagctagtttcaggatctataaaatgaatagaaggagatgttgaatggacagcaggtgattctgaatggataggaggtggtctaggatgaataagaggtgtcgcagaatgaataagaggtgctgcatgatggataggagatgctgaataaaaaggtggtgaatacatagcacctgatggtgaaccagcaggaggtggtgaataaacacttggcatcaaaaggggggttgtcgccagtggataggctgggaggaaggggtgctggtgtcgcatagagagggggggctgctgtcgccagggaggggagagggcgctattgcggtccgaggggggagggggcggcgtggtgcggtggttaggtcgggggggcgctgggtggtcgatagagagagaggggggctggctgtcatcggggaaggagggggcacgtgggtgtggtgggtagggcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacctatccttcaacatacccttaatcagtgcattccttgtgctcctcttggtggttctgatgcatatccacttcaacatctccctgtccagtgctcatctgtttgggctatctttattttctaaagctctttttcatacttatttaatgctttccccactattacatccaacctgttctactttagttaattaaggtttcatcaacagtggatttgggcaaaacctgtcatctgccttgtaaactcaaggtcttaaattttagaactaagatagaggtggccaaacatgagagatataatactgtgaccctcctatactgctgttgttcaagcacttgaaaggtcaattgcttaacaagttggttcacttctccaaatattgattacaagagtaacgctttaagaatcagaagatgaaaaaagagctccttgcctgggagtcccagatgtccatgttgcatgtaccatatttttcttcggtacttcagacttgttaagatggtcttgtttcttcctttattttcctccatttcttttgttttttcccctctctgtttggtgctaaaatcatcactatattcagcaatctaggaatatctgtcatcagcttctttgagtgcaattaaatgtttacatcttgacatatacttataaggtgctatttatgatgaagcatctgcattgttgggcacacatgctgaactttgttaagatgcttagtattttctggtctgccattgcagcttctgcttgctcttggcactaaattggagcatgtcattactcagttggcacgtgaggttgctgaaaagcattcagcaatagaaggtgatctggtagtcaagccatcagatgatcacttctggttccaccggccgcgtcttgtactgtaccttgttcactttatcctctttcaaaatgccttcgagattgcatttttcttctggatactggtaagcagcatagaaaataaaataaatcttgcatctgctcttgatattaccagacggacaacctccaagcactttatgtttatacagttgcaatctttccttgaggatagaacaaaaactgtaaatatatttgttatccaagccaattgatttgtccgttctgttgctattgtcggatttatgatttagctgccagagatagtggacaatctaataacctgtttgcagtttagatgctaaataaactactaacaagattttcttttcccccttcatcagactacttttggcttagattcctgcatgttggatcatgttggttttgtcatccccagacttgtgattgggtagctagaaacctcgcaccctttttttttccttcaagaattctaatttcatggttcgtatgctgaaaattcatgggtctaatttcttggcagggtcatcatccagcttctctgcagctatagcacactaccactgtatgccattgtctcacaggtgagcgtggtagcaaactatgaattataatgaactaattggcatggcgccggctaatttttttcttttcttttctctttttttggttggtttaagatggggagttcttttaagaaggccatatttgatgagcatgtgcaagagggtcttgttagctgggctgagaaggtaaagaggaggaagggggcaaaagtgggcaatgagcttgctggattaagccgcagatcagcagaatcttctgtcaagattgagatgcagggactcgttaggaagaaggaagaggggggaggtggacatgctcacccagatatgccatagctaaatactcatgcaatccatcaattggccagcaactatgatactataacttatatatccacacttaatatgccagtgcacattcagaacatgaatcgcatatgttttatataatgcacatgagggtgctgttcactgagttcctttctaaggttggaataatttactggcatatgtttcagattaagatatggcaggtgccttcatgtggatttagttctactatattgttattgctaatgtagagaaatagatgacataaaatagttctggtaatagaagattttctacattagatttctagtttggttggtttcatttagatgttttagtttactgatcattgtgcgacttcatcaaccggagattttgctattaatttccaggtggttatgagtcttgacaggcttctgagtcattgtctgcttgatatttttcaatcatggtaatgctgatgatattttggcatcaactcccagtgcaaatagctttcagttctctctttatttaaaccaaaatagcttgtcttctgatggtgggttgggtcagtcctattttaaaatatatcatgttagatccacgtctttcaactaatttttatctggactaatgagacgcaactttactacatttaattcaaccaatttcacaccccatgcaattggaatgtacctgagcaattgttggaaccacgcaggaatgttccaaatatgagtcagattcaaacagggtctagaacaggacggattagggcttgcaagccctgcttgttcccttggacaaacttttgttttgtgcaatgcattgcacttatgtctaaacttgttgcaaaaatattcagaatgaagtaatttacaaagggctagccctgaaccaaaatgttccatatgttcaatttggatcaaatatgaaactgatatcgggattatccatatccacaaccgactcagatataaaggtcataatcaaacttgttttaaatggatacaagtcaggaaattaaatattatgactgccaaataaaagatatcatcatgtaaatggtaaattaagttaataatatattaatatagtcacttatctcataaaaactataaaaaattatgtaaataaaactggatactagtcaggtgctcaatgttatattgatatccaaatagattcagatcccaacagaccatactagcacatcatagcatccgatctgcagggctgcaatgtttatactttttagcatgttatcttaacaaatattttagcaaccaagaagcaagaaagagtttaataatgaggtcacgttatgaactgaaacatgatttcaccggcacgatcccccacatctccacaacacagcagaggtaactgtttaaaagcatctaaaaatattgttatgttaagaagaaaatgacttgaggcagaagatatcaaaggaacaaatattgtaatacaacattttgttctgcacaatgctatatcataaagatcagctgataatattgcagggatgacagaatctttcactcctaccatgttatcattcttcagcagcactcgccgcactcagatccacactgagatcaacatcctgtggcaataagcttgtctttagtatatactaattgagaataaatgctagacttcactatgaagtgaaacaagagtgttacaggggcaggatgctactagagagctcctaataaaataaagcagaaattttagaaactaaaaatctcttatacagcaggtggaagcaagaaagactcagaaaaaagagaacaaagtaacacgtatcatcttgagatggtatattatgaagaaaaaccacaggaggaaacctaaggagacaatagtgtgacaagaatttatatgtcttgccatgcttggcttaacttgacggtagtattttgtaagaaaaagaatgattacagagaaaatagggcacaaagacacggcaaagtcattacctttcctgtgatcatgcgatacatgtgaagcacatccatgacagttgactcaaaatgtgtcgtagcatcataactctgcagacagtgcacttgtcagtgaacatctgcaacatcaaagctagaatatgtatcatcaatacttacagttgagatgaagcaattatccagtgagggttcattgacaggtacagatctgtcataagtttcaaaaaatagctcatctacaggcccgagaaggtcaattcctggctttagttctatctccggatgatcagtctcagcttctgttgagacaaatgcaacgaacttcccctttggtgcaacattgtgagaataagaacaacagaagagatacctataaaagcatacaaaatggaaaccactatgataggtgttgcagaaatagtagagaaatatcattaagaattcaatgcatgacatgaaactgattggtgcttcatggaagaagactgacatgtctgacttgcgtcccagctgcttctgaggcagaataacttgcgctgaatgagagtcatcagtatttgggatgggatgactcataatggcaatcgcccttgcaacctttccaaccttcctgacctgtggccaacgagtgaaagtcctatagttttagtgagtggtcatttatcctcaaaaaccttcctatataaaatctatcattagttctgctgctaccagtggcggagcctggcatcaaatattgggaggacgaagtaataatttattaataaatttttaaataaaatattttataataaataataaaataaagatatatatatattcaaaaatattacaaaaatatcaataaatatttaattttatgtataaataaagatatgtaaaaatattatattatgccatctgcaaaatgattttaattgtgtaaaaatctcaataatatcttccacattaaaggttgaagaataaataaaaagtcaaagaataaataaacaactattttttctttaaaaaatttactattttaaataaaaaaataatatataaatgattttttttcaaactagtggattcgtaatgtgtgtaagactaaaatattgggagggccactatatatatataaatatatagataataaatattttaaaattttttggagggacagtggccccctctggtccctcttacgctccgtcactggctgcaatacgatgttctgaaatgaatatgctgctgatcaagtcatatagtggcatatattgtccagaaataatggaaacaaatttacatcctaaataaatcacagatagggtacattctcagatagcatcagatagaggttgccaaaaaaaacaagaatgtttaccttgtttggtaagtaggaagggtcacacacgaccttcttgcacttagcagtttccccttccgatgtcacaccacaaacttttccttcaacatcaaattcaacctggcacaagtgaacttaatgcaatctatcaggaaaaatcttcattaagcaggacaaatcagtatcattccaacatatttgtatgatcatttataactatatttatactttcataaatcattagaggtgccttggagcaacagtaaggttgctccactgtgacctgcgtgtcacggtttccaaacactaaaaacagccccgccgcacatggggtaaagcagtatacatctgaccctccccagactccgcagtggcaggagcctcacccgttaggacaccctacttttattctttcataatgcaaaaaaaaaaacatggtgagcatgtatggcagtaataaaacaccttgcactctggtttatttaacatgtacgtcccaccataaacagcactaaggcgagcaaaagcctgtaagtccaacaaacacctcaagttaaatagatcatatattataaaaattagaatgcattctggaaatggccaacctgtggtagttctcctaatccatataaaggatagatatatggtgaccctccttgaaaacgagccagagattctgaataaagctgtcaaaaatgacaaccaacaccatgagcaacaattctatcccagaaataatagctttgggtggtgatgcaagtccattttgaaaagaattaaaacccattctctgattagatacaagaaggatgattcctaagaagagcacatgcccatgaacaaagggtagtgatgaactcaaagcacctacctggcagctcagttgagtccggtacggtgcatattttgctaaatcaaaggatttgaatacaaaggcctgttctcctaaggtttatttttgttaaaaaaaaaggaaaaatagaaaagcacctatgaagtatccaacaaaaatctatatccgagaaacaacttgaagaatagaagatagatggtaccatatttcaagatttaaaatctgaaacttgagaagcaactaaccatcctaattagggcataaagctatatatgtccttagcaagcatttccacctatgagcaagactgcattatcgagtaataatagataatccatgcacattctcgaaaagaatcaagatacatgcaagagaagcacaagaaaaaagtgtatatgttatgcatcatatattgataatacatttcatctttagttctccactctcatgaaaaaccttgtcaacaaatacaaagaaaagatctgttggatgagtgaaagttacagcattcttataagaaggccaaatcgtcaactatgatatgcggcaaacagattcactccctttgctacttttgtgtcttgaaatgtccaaagaagctacctactaaaaaaactcacgagggcaaagttttataatttttacctatataccacaaaataaagacgatatatgcaactagttcaatagcttttctataaaagctgtagtcaggaaacatggaggatgcttgatggcaatggactaagagttgggagagatgacttcatcatttaagcttcttgtgctttccgaacctatttcaaggcaattaagtgtttagctggttgtatatattgggtcagttttatatccattaaaccaaccggggaagcatgtgcaaaataaagaaacagaatgccatcttcatgggtccaaaaatacaaaagtcgaatcatgaatggatttttaaaaaaaataaaagaaaaaaattaacaaaaacaataaaaaaatcttactgcataataggtggttgttttgagcaatcaagaagagtgtacgcacttagcaacaacccctaccttcatcctttttacagtatcaagtgcaggttcatctagatagcgatcatctctgtgaagagccagtgcatgaccaatgaagtccactgtattgtcatccagcccatatttgctgaaccgaaaaaaaaaaacaaaggaaaaaaggaagcagaatgaattgcaagagcaaggtataaaaatgctgctagatcatattgtggtatcaaaacatcctgcccatttgtttctcacagaaagttactaacggacatgaaacaggctaaattaaacacagaaatccaatggcaacaacacagcaatattcatcacagatacatataaaagcaatcagaatttggttaagctattagagttaaattgcaacgaagagaatcttattttagattgagagaatttgacaaaaagagtcaagaatgtgtcatgaattgaggtattcttaagaaaacatgtgacgttccgatatcttatgaagttcaaaaaaaagagcagaaaatgcttgttggatggaggtgttgcacttttagaagaacgtgtgacattatgatatcttatggagatcaaacaagagcaagagaatgtgtagtggatggaagtgcctcagtagttctgctatacaagatttaaagaaactacctcaagaagattttggtgaggaggcattataccagctgaatagcagaccgcagtttcaagaaatgcaagggttgtatcatgatggtttttcttctaaaggtttgcaaccttataaaataattacacataagatatattctcaaattactaggactacttccctaagtggaaaaggtggaagcattataattaatgagtagagaaaaggatcaaaagaaaagaagactgggatgaagaaaaaagtggtctccctatttcaaatatttactcagcattggaggatcctagtccaactaggactctcatactgagaaaagagcagaaatgtctaaggatttcctttggaatttaaacaaacaaacgagaaaaaagtgccagccaggaaagagacctctttctcagggtcctaatatcctaattcactccttatctggccatatatcatcttctattttctttctcttttttgaaaatttcagaaagaaaaaagattctcgagagaaactaccacaaccaccataaagtttttatatgagttcaggaacccaatttgtctacagggctcttcattctgaaagcatagattgcttctgagagacggttcagatcccatacaaatggttaattgtaatgtgttcaaacgagaaaagactcttaaaggaagatcaatgacagaccatgctaaggtaggtacagaggaagtcgacaaatattttcttgtagttcatttttatctgtttgagtccctggaggctacattgagttaagaaaaggaacagtgctcaaccattaaagtgactcactaaaggtatttttctttgtagaaggattaatatttaaatctttagggaaacccttgtagtaatcaactagtaaagttaacatgtgataggctagctatctcgcaacatccagacatgtaggttatcaaattaaaaacaagaacttcttctctatttttatggtgcaattctgtgctataaagcaagaccttttagtgctaagtgtcatagctgatgcaaaaccgttatttatcctctccccctcaagattctttcttcttaaattccttatttcgttgtttaattttctagttgatcccttttagcatattcctaaggttctttaatctcatataaatattaattttaatccctattactgtccactacagggctcttgcttggatggtatcaccttttgcaatttgggcaagggagcagacttcaattctggttggagccagccacctgagggtggggtgatatggggcaaaaaacgtggggattagctatcctaatttttttaaaaaataaattactttccacacctaccttcaatgagtaatattttattttagtctgtactttaatttaaagtatattcagattaaatataaaatttcctcaactcaagttctagaacttcttggctggtttttcttaaaatttaatatcttattgctcataaatgagttccacagatattgattgacttattaaattgagccttcctttttttcacttgttaaaatgccatggtaatgtcattctttcagcaaagcaatatgtaatacaaaccaggaattccacaaaatatatcacaaacaaacattgtattgcaaaaagcagagcttcatagtgtggaagtgatagatataggtaacagtaattaggtacccacgagataagtgctctagttgtcactcttgtaagatccaatccctcatgtgtttttggatcattttcatcataatcctgaacataaatgataaatttccgagctcggcgcttctcaaacaaacccatcaatggagatttgagagcttctatatcagttgcaggaactttgtgaatctattccaatgagaaaagagcagcaggtattaaacaaaagcatcatcgaacactcagaaatggtaacaaattaccaaaaagctaggttgctcaaacatggaagcaactaataaagcacacaaacaagtatacctttcctttattaaagacatagctcccatctgctgctttgaaggaaaggtattttgtaacatcagtatgtataagaacacgaaccaaagtaccatttgccatcatgaactagtcagacaaacattaattaatcagttatattacaaagaataaaagaattataatagaatgcatgtacatcaacaagattgttgtgagcactgctaaattgataaggcaattaacaaagcaagcaagcgtgtgccctttgacattatgatatgacagtccgacaaataattcatggttgcaaataccatcatgggcttgcccaaaatgaacattttaatcaagctgaattctttcattataaggtgtacaatttaaccacaatttgcttgcccacagtttattcttctgcaaagacatctataatatgaaaaatgaaaaaagacgtaatactattgaaaataaataagtagaacctttgactgatggtgttgtggatccctagcataacaaagtatgcgctgtattttgttaactctacaaaacatatagctgtttaaaagttttaatagcacttgctcatacttttcacctgcaaggatctctttaacagtatggcacatagacagagtacccacatgctatgctagacaacataaatatcaagcctcatgcaatctaattgggtttcatgtaacgtgtgtggattgtaattcaccatagcttgcatgtaaatccaagcattgtagattgaaaatcacttccattttcttcttgtcacttccacccaagtttttctttccccctttccttcccctcttctagatccacaagttatgccaaggatccttggtgaccatgtccagactggcagtctctcattaaatctgtcagaaatgtcttaatagctcagttagtgagccttatccaatgtatagctggttggttttatagattaaaggcacaccaaaagtaccacaaatatacaaatttctgagttgacactctctacctttcccacttcttaatatattctgctttgtcaaacatttcacatcaatgtgcccttcatattgcccacagtttcaataaatattcataatccatgagtatcctgatgctttcagtaaacagagattagaagatgaaatttataaatgggtccagtttcttacaacactcattaacattctcacttacattctgctcaagcaacacttacctaagaggtttatcctatgaaactacgtcttccactacaatgttccatcttgaagtgccttgtgactataaagcctataaagatacaaattatataggaaactttaacattgaatatggaatataatacatggaagttcttcaggttaaaagttttaaatatcagacacctttctgggaacctcatgtcacgctattatgaaatgtacaaaaagttgaattttcttagttttttaaaaccttgtaataaggcaatccagtaaagaaacagaagagggaaacaacataaattaagagcttaaaaagttatggcactacacaaactgtatactggttcaagtgattgtcaatcactctgcccacctcatatcactagttcatcacgaccatttatcctttttattaaaacaacttattgaagtagtctacaagtacgttaggtgaaattcagcttgtactattttgtgacataataaatcatgaattgcaagaatgccaaacaaacagacctttgggatcatgtcaacattgtaatctctgctaggacctaaatgcgccggaggcttatcgctgcccctaaaccttttccagagctgcacaaaaaaggatgctttagtcagttaatattgctcacgatgtgaatgtaaattaaaattaaaattaaaataaaataaaatacaataaaaaaacttttttgatacatagcatcaaggatttcatctggtcagacatcttggttagtatcaggcacccacctatatgataaatagaaaatatcagaccttatgatatagttcaatataaagtgatagattccaagacattggatggtccaatattaatattttggcctatattttccatctaccttcttttagttcctgaaatagatgttttgactaataaatctccaaaatcaatgtgtaaaaatacttgcaaatttcagcccattgatcaagattttcatatcttctgatacatcagccgagaactcagaaaatcttagatctttccaagttttctgaccttctattagagctgagataaatccacagctcagttcatctcagtcttggtcacacatcaagataatcgatattttactctttaaaagcctacacagtggcattcatctttaagttaagaaagaaattgctgaagtctttttatttatatattacaatgaatggtcccaaattatagtacctgacagtgacttggagcttgctttagtctagcagttttttgtcagatggtattagaacaacataagaccataaaggtgatagatttaaacaagtgtatatatcgtgcagtaagcatcagctatttaatcatcccagatcaggtccttgcctggatgagattaagtgaagatgactctcctccatagtaatcattcctgtccatgtgcaggacctaatgcatgatggaaagtaaaaatattgttagaaaccaaaatagcaaactgcagatataaattttagaagattttcataatttctcatcagaatagctgcacgacatcttctgtcaaatcatgtataaatgttcttaacaatagctagaataaagtgaatactcggtgtcaggtatgtatacttcaatcactctgccgaattaatatttaattttcagaaaaaaagactcataaaaatcaaataaagacaaaaagaagtctagttcgttccagatgaattcatcaaaacttttcctgggcagcaataaaagtgtcaagcatcagattgcaaacatgctggaaaccaataaatgacacaattatgaaacacccatgtttatctcaagctaaggttctttttaactgtttaaaaacttagaaatgtacttaggcgatctgaagataatctctgatcatggtgcaactatgacagtacaataacaatggcgatgttcctttaagtcagcacataaaactgatcaagttatgattcataataaaatgctaagttagcaagattgagcataaaaagaaaataaactgttatatttataaagtcagtagaatagcttttcattggttcaggcatgccttctagcaatgcaaatatcatgaagaaattgagagaaatgcacatatcttaagaaaaaaaggtcatcaaagaaaactaaggttatctattcacacgctaaagcacattcgaccaagactatacggaataattgaaagcacaagcatcacaagccagcaagtaaacaagaatctgacctcattttaatactgctacaggcatcacattaaatcaagtgatcaaaacattttcaccattatggagcaatcagaaaaccaaaagacaaaattgggaccaccaatagaactccaataacctctcatcccacttctcaagtatcatctgaattgatagatgccgcgcccttcatgcaaacgacttaaaagaatacttgctatatatttttcatgtagataacgggatagcacaagaaataccaaatctatatcaaaaccagaacaatccgctccacaaaacacaccaagatacaatcttttaaggtcatttcagctatcaatcataacaatcataataaaatgaagaaataatcaccaacataacacaaaaggagcagtccgaaaagaagatcttttaggaatctaaactcgatcgccaccagttccaattacatgaacggcatcgccaacagatggtgacagcacccaagattcaaaacaatggatcgcgtaaaatccaaatgatacaacagatcaagagagagaaagaggagaccttgaggccatccacggatagaaggccgctgaggatgcactccttgagcccggtcccgaggactatcacatcgtactcctcatccatagcgaggccgaagggagcagagagagatgagagagatcgaggtggagaaaggtatcaacaaaagaaggaaaaagggggaagagacgaggaggagaagagagggcaaaagcaagagaaaggtggatgctttgttgagctacagaagccagcagaggactcgattagacaggaaagccgaaggaaggggagttgacaaaaatacagggggaaaatgatggacaagatattggttgtggtcacctatggtgagagtgtggatgttctccggggtaattttttcttctggccaaacagtcaggatattaactttcagttaatattcatttcaaaatataaatttattaatttttaaaaaaaattaaaaaaatattttggatgggaatgaaagttaatattattaaaattttttaacagaatagttcacgtaatttacatataactcttcttatatctgatatggtatagttcaagaaaaaaaaaaattggattgacgtgttctgacttgcaccattttattaaaaaaaaatttcaagagaacacccagcctcgtacactactcaaaactttcttcttttctccatcgcttattgtgaacgacacatctcccccaaatctgatgccgaaaccctaatttttaacgattttcttttggcagatatttcttttttgattgagatccgataacgaaagcttcagtttatggcagctccagcgatctccgatgagggaaccctaaggcttcatcgaggaggcaatgagagatattttcactcgatcggagagttctcgatcacgatcgtccagaccaacagggttttcgaggaccacaatcagattgagacgagacctgacaccaccttcgttggggtctatgacggccacgacaagctttacgcctttcacttcatctctgatcacctttttcttcatctcatgagtaggactctttgttcgacatctattgttgtttttaaaattttctttttatttcttctcatcaactgctcagaaatgtttatttcactgatattggacttatgaagcttatctttatgtctaaaatgtttctcaaggtgtgttctttattttttttattttttttatttttttgataacatgacttgcactagttggttccagccctcgtttataaacagtcctttctttttttatttttttcttaagctatgccatgtcagatataaggagagttatgtgcaagtcatgtaacctattctgttaaaaaattctaacagtcttagctctcatccttatctgaaattttttaaaaaagtttgtccttctttgaaaactcgaagaatttttgtcctaaaatggatattaactgaaagttaacgtcctgaaatgactgtttggccttttctttttattagcacagatagtggccttaaaaaaatctaccccttgaattttacatagatttacacatattctctacatatcaaccttccattttaacattattgcaatactagcataaaacccgtgctacattgtgggttttaataaatagaagacagagtcaaaaaaattctcaacctgcgatgccttcaaaacatttgttaagaaacatgacatagaatatgcttgaattataaaaatattcatgaattataaatattcaccaaagaattgaaaattattcttttaattgatgttccctaatctgaaaacatagttggaagaatagaaaattaaataataaatagaagagctatagtttctttactttataagcaccacgattagttaatttaaaaagtattttttgataaaaaaaatcttcataaaagagaggattaagaaatgatggatccttaatttttattataataagttcattagaaaaaaaatcttcaacgaaagaaataaaatttttatgcctcatgcaagaaattaaataataaaaatttaaaaaaaaattagtttaaacataagaaaagaataatgccaatttaattataggaaagcaagaaatcaaaccgtatatattctttttttaaatttaaagaaaaaaaattattcaacccttcctcttttcgatcatttatttttatttttttttattttcttctccaattcaaccttctctgtatccctatcttaaccctaaccctagccccaaccctaaccctaaccctaaccttcaaaaatctaactctaatcctaacccttagcagaatctaaccttaatcctaaccttcagcagaatctaaccctaaccctaaccagccacctagccggatagctaaccctaattagatcctctatcataaccctaaccctaatcggatatgctaacctgtcagtcgaatgatctatgacccatttggcacacctgttaactgatctgcatggattccatcacgatccattcttaaacccattaatctgtatcttcttttcctatcttaatccatttatttctttctattcatcaaaccctaatccgattcgtcaaaactaatatatatttttctttctgttcatcgaaaggtttcacagcaaatctctgttccttcctttttctattctctagaaagctgccgaatcttagcagcaatcatgacattttttttcttttatgtggatgttgaggaaggatactatagtatggcagcaatcatttgtttttctctttccttacataatgtttgtaaataaggagtggaaggctgtcaaaacataggcagcaacccccctgcattcttaaaaagaaacagaatgttctttctaatattactgtgaaagaaaaaattaactgatgagagaataaaaattataaatatttaataaaaataaatccaaaaaataaacaaagatccctaaacccaccttctctagctctctttactcgatttttcttatctgctgccaccatcttcgatctttctaatcctcaataagtctgatgaaaaataataaaagtagcaattataaatagatccaaaaaaaatactccccacctcactttttctattcagccgttctcgatgtttgaataatgctttgaaccttcccacatatatataggctaaagtataaaaagaaattgataagataatccatgctttggcatcaatattttttgattttttctcaaaaatcttctctctgagatttcttttcatccaccacattcctcgctcttttttttttgcgggcgcctctcttgtgatagaaaatgacatgggagagaagagacgctgcacatagagctccatcccattcctctctttctttctttcttttttttgtgtacgcctctctcatgatagaaaatgacatgggagaggagagttagagtagagccggtctgctcagccattgggagcatcttcgatccatccaatccagatcgctatcttctttttcaaacgaagcatcatattttttctacatgctggatgcacgccatttgtccccccatggatagctgacacttgtcgcactgaggaggctttggtctcaaatttaatgtattgtatatatgatccatctcctcccaattcaaattaaggttcgttggagatgcctacgtgccagctaatgtggattcatgattttgatgtggattcaagattttgatatggaatcaattatttgatgtagaagttatctccattagagcaaaggttaggatttaggagaaagaaaatagaagacccctttatttaaagtgaaaaccatagtgtcatccctattttctcccctaggctttgaggtcaacatatgttccaattcttagacagtcattgatctaaattcaccaaatccatcaagaaacagaaccaaaaagaaatggaatgtggcaataataatataaaagggtggtaaaaaaatcaatagtatattataatagtggttgcttattttattggagcttatttagtatttacgcatcgttcaaaaatctcatagtagtcacactcttcccaaattttattagaccagctcaattggaagcttttttttaatatctgtctaaaagttgctatacaaaatacttgagtttcttctattcacctcttggtacaagaccaacactaccacaataactcatcatggatcattacaatgaactcatctgatgagatatcactgcaaccaactcatctctcatcggctacttaggtcctagcaattgcaccacaaatgtatgcaagatagttttgttgctcactgagactttgtaatccactatactgatatgtaactccttaagaacttagattactttagaaataagatgggtgtccatcgggcaacttactcggatgattgccttattgtgcacagcctggctcagggcactatgcctacctctttgatctgctaatgtggattctagcaactattccctcacaacctccattttcctaggtttcttctagagattagtaatgtaagttatggcatcattaagaaaagcgacctttccatctttggatattttgcattatggcactgggaatatagagcctttagttgagcttctcccccctctagctagcactcagcctaaatatgattgaggggcgcctttatctcatttgttagcttctagcctatctttcttggcccctagttgtccattgccctcgacaacttttccttgtatgaagtcttcacatctaaatgcatcgactcgaatgcacccaattgagtaaccaataacccaaaagccctcaaagtcaccctaccactaaaatcaatttaccgattgtgattttgacgatggttattgttgctttggagttggaaactagttcatgcaaaggtctttcctcatcttgttactgtaagaaacaaataccctaggtgagggatccattttgcaactgccaatcataacaacatcattatccaacctttgtcgatgagaatttttagcataaccacatgtctcactccaattcaaaccataaataataccattggagatcgacatcaacaccagcattagcaccatctaacgatgatgatttctgcaatttggttggatctccaaatgatggggtctcatactaccccctttctgtgcctcctcctcccttccatccggctccaccactggtgagatcaccattcttgttagttcatggaatctcttttccttcttccaaaccctaaccttgctctcatggagatagcttcaacgctagataactaagtctacgttagatacctaagtccatatcaaatataactccctttatgtcagctgcatttaggcatcttcgataaaccctaatttgaattggaagaaggtaatcatattgcagtaatgtatgaaaatgtgagattgatattacagtagtttaatacgtagagagattgacaatttcatacaaaatgcaagggtcatttttttagcctagttagtgttatccaaattattcaaggttttttgaaatgtacataacttcatatcttcccccagagatgaatggtcctttgaattattatctagtatttgaataaatcataatagatctagtaaataaataatttatggtgtttgtgcaataatagatagaaatgatgatatatgttttgattttgtatttggttagagccttggttatgtgatataagtaagcacctagaccagtctaatcatttggaatcagtagttttacaaaatgtattcttcagctttagacaacataaaaagctcctcgatttatataatgcatgataggtatttgctatataaaatgcatttatagatcttcaaaatctttcatgatagattttacctctaataattggagtaaaggaaccactgatcaaaactttatgatattaataacttagcgtagcactattacactatgttattgcacatgagaggtattgtccttttttttgttatttgttgtacaaaaattgatgtcaataatctatacctttcaagcaataaaattactttttaaaatttagattagtttcttattcttaaaaatttattggtatgaacttatgactccaaatcttttgactatagtgtggtctaaacatatctatactatattgttaaatagaagaaaaatacatcattttttattttagctacaaatgattaaaatatattttatcttctcttcatgaatcgaagttttaacttcgggtccacttgaaatacagccaagtcaaatcgacatgataagttttcaagttgacttgatagaaaatttggtttatgtaaaattcaaattttggattaatctcggctcaattgacttaccaaattatttgaaacttggttcaaattgtttgacttggtaaagtatttaaaactaaccacaatctattttaatatttttttcaaatttcactcaaaagagttattgaggttagctttccatatttttattataaagaataaattacaaaaatcctcctgagatttacgtttattacatttcaaccaatatgttgaaaaacctatatttacacctctaagaaataatggtgttacttaaaaatttcaaacttctgaaatgaccaaattacctccgagacttaacaaagcaaagtggacctaggtggagcacagcgactagggcactgtcgaggcatccttcttcccatgcggacccccgatctcaaggaggtggagggggatcactttagagtggctgatggcgatcttgtgctcctccacctcgaataggcaaaggagggcgatggcagcgttctcgcgggcggtaggggtacagtcttgaaggcacgggagagggagcaggtggctccgatggtggtgatggggtccttgttctcgtcatagaggcagaggttgagaatcgcgatggcgtcgtgctcctagagctggaggtttgggtgggaaaggagggtgatgaggggatggatgatgtcggcatggccgatctttaggcggttctttggattgtgttgagccaagaggtgaagcatcatggccgcgtggagctgggtttcgatggaggaggaggactctaaatcaaagatgaggccacggatgagctcgtcgaagtagttgacggtgcaggacatgaggaggtggtgaagggcggtgctaccgttggaggcggagctagtgaaggaggggaactcgcgggagtggttgctattgcagtcgctgaaggcatcggaggagtcatcactatcattgaaggtgcggcccattctttcttaccccccaccaccaccatcgctaaaggagtcatagggacacctccaccaccgccactggctccgttgtgatggacacgagcctcgtggaagcgggggtgtggtgtggcagtgttcaaggtgaggaggaaggggttgcaggaggtgggggaaagaggctgaccactctaggataatggagacgaggcgagcatgggagagaagacggaagacggcatcgtaggtagcactagagtagctatagctgggctagcagtcggaccagtccaagaagtggaggtagaggaggagatggtagagggcaaggcgatggtgggtaggactggaactagatcgagctaggctgggctctacccctacctgagcctggctcaaaaaatttttttgggcttcgggtcaggtttaagcccgattattttgaaaaaaaattggcccgagcctaggtcgaagctcgattgggccaacccgagcctgccttcctttatttcgacttcgctaggttccatggcctccactgaaaacttgttggcatcgccgcctgtgttgtccccgactcccaaaagcgaaatccatcatcaagaaataggttaggattacggatagtgggattattgagattttggcgggtgtagagcagaaaatcgaggccgaagaggtgggagagggagtgaacaaggtcgacaagattagaggaggggaagacctaggagattctgatggacgcatcctcctcctttgccttcctcttcgatttatgtagctttgtttgatttaagcgactagtgggaggaaagcggggagggaaaaagcagaagcaaaaatcaggggagaaaggtttttttttggagatctatgggaagaaaatcacctgaggaaaagatcgatgtcgacaatgatggggagaaaggcgacagcggagatcaataggaggtggcagcaagcaaagagagaggaggccgatgaggaaggccgatgctggtgcggtgaggagagcagagggaagtgggcatccgtgagagcttcgatgaggagagaggaagagggctcgagagagtgtcgaagaagccaaaagaaaaaaatatagaaaggagagttcaatcctcccccttcccacttccccttcagcctgggccaaattttgggctgagcccgaccaaaaagcaaaatgggctctattttttggcccgagcccagcctaaatggttttgagccgagcccaaagcttgaccccgaaattggcttagcctgatgggtctcgagccggcctgagcccacttctagccctaatggcggggtggagatggtggtggagggtctagagcactcagagagatgagaccaaatttaatggagatgaaggttctctttttatttaatttttttattcgagattattttggtcatttcaagaatttataatgacatggcaatgaaattcaagttaatattaacggacggtctaatggcatgggttagactgtaggattgactaaaatattaaggatgtaattatagattttgaaaactattggatgtacctattatttcgacctattttctgaaaaatttttgtaatttattcttattatgaaatatagtaatataagtcaaacaaaaaaaattttaggaggcttctacttcttacatgctaagaatctctataatgatcgatcttttcatgcacccccacaatcctattatttgtgttcccattattagttgagggggttccattcaccatcccctcctaacactcgatctcaaaatacaatattatttgatagcacgttaaaagagtcattgacatcttaattttttttattttgattgttaattaatatactaattatatgttaataatcaattatagatttaagtcttatgttccatatataaaaatatatctatttatgttctttaaaaatcaatatttcataatagatatatatttaataataaatatcatatatattattaagtccttgtgttcgagacttatttggtattaccttgagtcttcgaacggacccaacttggcaaacttacaaatggattcaaatttttaagtttttaaactatatcatgaacatcctaattatttatttatattgatcacctataaagtccctcttaaataaatggattcaattttgtgtaaaaagaccctacctatctcttgtccatatcccaagaaattagaatcttattaaaattttaaaaaataaatgaaagtatcaatagtcattctcttcttcatgtattctatccatcttattccctaatcccttgaacttttttttttattttagctttttaacatagtacatgcatttgaacaatagctaaccattcaaaaggaaaaatctgagatagctttgaaagactcttttaattttgcattttcattcgcaaaaaagtgaaacactctttctttatttgatcataacactaatcttcccttttagtaatcataaatatcaatacttattatctacttcatgtattctatccatcttattccctaatcccttgaacttttgtttgctattttagttttttaacatagtacatgcatttgaacaattgcttgctattcgagaagaaaaatctaagatagctttaaaaatctctcttaatgttgcattttctttagcaaaaagtaaaaaacttgttctttatttgattagaatgctaatcttcccttttagtaatcattttctttctcaatctatataatcatatctagtttagaggtgccaatggatcacattaaacctaggttcgattgaaaaccatcaatccatacttgactcattagtaattggtttgagaagtataaagccataatcaaaccatttattttatatggatccatgcttgaccaaccaactcatttatgtcagtcatatgtctcaaataatgaaaaaaaaaaggaccaataagaagggatttagggttaaatatcttgaatgaagcaagcttggggaaagtttaagtgaagaaggaaaatagactcttagaaaattgtgcacttcatatttcttcttattttagattctcaatacttctaccgctccattttcataagagtggagaacccattattgtctcgactaaagaagtcgaaatatgagagaacttatattaggatgggcttactatctaaatagttttaagagttatccgttctacatttgactacttatcatttactatgagcaggtgtgcattccaagtcctcttgtaccatggaaagatcctttaaatgctctaacacatgcattggagaaggacagaactatcttttattgatttttttttttctctttactcttatttggattaactattgagatcacatcagacaagcttttactaacctaaatcctagcatataattaccgacactttagggtccttatcctagaatttttttttaaggaaaaatttttgtttcaccctctacttttcctaatttcagccacacctctctatcttaaaaattttcatttggatccttcacttacttgactatttcaatgagatcctgccatccacctcaaccgagcccttgatccgatcttagaaaaaaaattgtgtcacgtgatggctcaaaacatttttaagcctaacacggttgaggaaaacactggtgtttgatggcaaatatgtagataccggtggtggaggacgacgtagcggcgaggcgaataggaagagagatatcaaaagtatgtgaaaacaattcaaaccgatcaatagagcgtcaacaatcgaatcttttagaaaaaaatattcagatatttctgctaagaacgaaaaattcatcgaactacgctatttcttggagaagtgccaaaaattatatctttttttagccaaaaaaatttataatattttctctgcgccttcaaatggatagtgttgggatataccgactgatctcatacaccgacttatcctcggatcgatccaaccgacacccgactctacccaccggacagacagacgactctgacaataactgccgacagtatccgaccgaagatatgccggtcaaacagaccaatactgtttccaaccggccgaacggccgaacccatatcactaatttactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggattggctgcaccagatagattgcatcacggaaagaagaaagatgaagggcggatttgcgcggggttttggcacctcttgcttctatcccggcagcgatgtcaatggtaaccgtggcccttccgctgccacccaggccccacggcgagtattgagatccccatgaagatcggatgtcgaggagttctaccccgctgtgctctcaagagatcgaaagcatgagcaagagcaagagcacaccaaatgtttgatgaaatacccctctagtggtgataaacctcttgcaccgtttgcagggggagcctaaattcttcttcttctttttttttctaaattgttctctcctcttccctcaccacctcctttccttctgcacactagcgcccgactcatcgcctacagcatcctcatcatggagatgagtgagggtctagaaataggaggtcaaagagatgctcatggcaccaagaagtggagacggatgtggttgggtccttcgggattgaagaaaaagcggaaaaactaacatagccagtgacagtctataggtatcaccttgtccgaaggatgggttcggattattctttccctattggtaattcttcaacttttacctcattttgtgttgcgttttgaaaagcttgcaatttttggataatattgttggtagtttagcgtgaatgttggatatttagtggttgctgtggttgtgattctaattggttcaagaaatattttatgcatggccattctaaagctcttcgcttttttgactatatgattaatagtgatctggatattagctagtttctcttggaatgccgatatttgtgtcaaagtttaatattttatttcttttcaagtttttgaattcatgattttggagaaatatgcatccgagagtgatctttaagcatgcatgcatacattgtcctgtgcctacttaagaaagattttgatgattcatgaattagaatcactaaaatttaaagaaaacaaatcaagccaatggaatataaaaatgatatttatgttcaacaaaatcttattcattaaatcaatccatcctaaggatcaactaaccacccaaacttaaatacagtgcaatttcaggatcgtctactaaaacaccatatgagtttggctttgttcacttgaacaaggtttaaaataggtttactttggaggtcttgattgtaaaactatgggtaaagttgaggtttgctccagttgatactcttgcaaaaaatatcagttagtctttaattggattgacaaactgacatgctagtgcaatttggattgcaatcaaatacccaagttatcaacctaaagttgattcaaaatcacattgtgttgacatcgagcataacccaggttagttatatattaacttaatccaccctaagttacaaattggtcggattaggattgggtaaaattggccaaagctgcacccttctgcaagcatatcggattaacaagttttataggctagcatttctctcttctcatgcagctcacctctcaatgactcggccatccaaccaccgttactcatggtaattttttatttctaaaatttaatattattgtgtatcttgaatttttttggggcttatgagtgagatttcttattgtgaagagacaatacgttaatgagcaggcgaatctcttcaaatttagtagtccgtgggggtttatatgtccaagagaagtgcataaggattgattcatttgaagccaagtaggccttattgcattggttgagatatcatcacaaatgtaacaattttgtataggaaagagcaatgcctattcttaagacctctataatttaatttcttcacaaagcttatctattccctcctcctagtgtccaaaaaataagaagaaaattcccatctttatctttttacttatgatatgggcaatttctaaaaactattatagccctttataatcccaatagttttttttttaaaaaaagatgcaattaggaccatccgctattttttttgaaaaaacaatcatgcatgacatgcatcaatgtcttactaatattaagaaatagtaagagaatctggtgttcagatcttatgaatagaaaatattaagaaaaattttctaatgcatcatcaactaatagctcctcggaaaaaatagcttattcaatatttgaacgaagataggactttggtggcgggctttttaaattgatcctatagggagagaatggaagtattattgtatacagagaagggaacatgcatgatttcatagcaatgagacagttagagttcttttacaagggaaatcctcctattttgtaaggaaaaattcttcgaggtctgaattctttgcaaccaagatggcacttccatgtgaggaaagaaatggagtgtcctttggagaggatttgcactaagaatagagttggacatttttgtttattagaacaactcttgcaactaaatgcaatggaaagagtagaattggctctaacataccaactctagattgaatactctctgcatatggaaccatttctagatataatggcagtcacatatggaatctaaggtcaatattaattttcattaatgagtcacagatagttcaaagatatgggagttgattgcaggatttagagagttgggagttgtttaaaagacaaggatattatgactggaagagtgattagtaagggaggcatgctttgagacaaactctagctattatattgagcatttggaagagggatattttgcgaatgtgggcatttcacatagaagagacgttggcatgtttatatagttttcaatatatacacacacacacacgtacatttttatatatacatatattatattaatttacattgaatttggaaatagggagtttgtcattcaacttggatgaagttcttatatcaaccatgcttttattttgtaaggtgcagggggtatggaaaggtcggtgctagaggtgataaaggatgtgagtggggcagtagcggatgctgaacaagatgaaatagggattttgcggtctaggagattattggctagtgggccatgtcattgtcggagggaccaagcatagctatcaactagaggaggcaatgggtgtggaggctataaggagacagagagagattaaagggttggccaaaggttaaggaattattctattctagatgggtagtgatgcatgggtgaaggataacctaggaataggatattatgattagcacaaataaacacataatttattgctctagaagcatagcaaacaactcttgcattataatttttcttatacgcatgacccattccacatatagtattagatggtctaggaactaaaagtaaaacagtcaacaaaacaaagggttggggatagaatttctgcttaaaaggttctaaacataaagtgataatcaaaccaagggtcataagtaaatttctccaagaattttcgagggttgtttggttgccatttgcttccatttaatttaaaatactttggagattttcttttatcgacttctttaatagcattaatatcatgcttccatgtatggaagggtcaagatattactttgatcatattgcttgaactttgtcgggacacggcggttgcagggttgttgccatcagagaaatgggtgttcggcatgtgttggtcgatgaactggtgaaggaaatccgtcgaacaattcttggtttcttgagggaatcattattgagcaaaaatagtcattgttctttggattgcacccattggggaaaaagcctttggtcaaggaaaccgcccatggcagaggaatctgaggattctcagaaagataaggaatttcaaagaggggaacataggaagatggaggggttatactggaggtttcaaagggcattggactctcatgattgggaacttgctgagagcttgattttgtcaatcgatctacaatatcataacattgggctttgtatggtggtaagtagtatttggtttctatacacaccaagatttggacaaagctactcacttgattaaaaggattgtctcaaatggagcacatgatttcacaaaggtgacttgtcagagacgtcttttcttgcattgtgaattttggctcctctaaattgcacaatgagctttccaaataccaaaaccggcatgattaagaggtaaattcttactattttgattcccttgcatatataatcttagcaatcattgtattctatatttgattttgtaaaatagctcactctaatttttcgaagagatcaagaattgataattgtttcgtgatatcctgtgattgtgaagtctcatcactttgatttccattaccttgtaccataaaatgtggtgtcaagggtcatttattatgtattttgtttgtggagaactcattcaaattcctccgtataaatgacatattgattttttattactgaatttgaagtgttgtactcagtttgctacaaagggatatttatacaataatagctatggaggttaatattcatgtatgattaatttgtttttcttgttaattttctataaggtgaaagaacacctccaagcatataaaggctatgtgcatacgaaggccaattggagtgccaaccttgaaaaattcattgcttgggcatttaatctgatagaattccattggcacaatcaaaaaaataaggataaagatatccataaatcaatcttcgaaatccaactacaattgccagcatataattcttttttaaaaattgctagagaaaacattacgggacaggagtttggtagggcctttgatgcagcctactttttaatccctctcttgtctaactcagttaaccatggctggtcatctggagtagcaagagatgctgtaccggagttactaggtttcttggtggaggggggtgcagaaaatgtaaaccaatacttcatgaaagctactcgatttgggagcacagaacttgtaagcattttattgcaggtaatgtatcctacttttgcacaaaagcattttacctatggtagctctagttatcctttacttttagttggattgtaataatagtgcagataattgcagaaatttcttatcggattttaaataatattggaaccacagcttgcttctaatcagtggacatgattacttagacaagctctaattttcattattatccattctataaagaattatcctaattgatagtaggatatgggaaaaatgtggtaagtgattatctcagatggtgatatatcttcggtcgtaccaacctctctagttttttttcttttttttgggtgcgagggggggggggggtggaggtgggggtcacagggtttggaagaaagtcaccacccatttttaaaagagaacatgacattcataaaatggggcagacaggtgcaacgcgatgactttaactgagctataaaatcatttagtgatgagaatggaagggaaaccatccacaacctttttttaagttcaactcatgtttttgccaatgcatgtatgatattctatttgtaagacaggataaggtcgttgggatagtagcatattattttagaattctgaacataaaatgatgtgtaagtgttacttgatgagatgagaggacaatgattattaagatcatgttgccttgggatttactatatggttatgatattctattttggaggcaggataaggtcgttaggataatagcagattattttagaattctgaacacaaaaacatcaaatgatgtgtaaggcattacttaatgagatgagaggacaatgattattaagatcatgttgccttgggatttaccacatggttatgaaaatttattttttgatgtaagatcatggtaattgtcttgaggaagtgaaagcttagatgggctaatgggtaaactgacatctataaatgaaacatggtagactgaaaatgttcataacatggtaggaattataggactagatttatgtatacaaatgggctatctaacaatttttgcaactagtttgaatgaggtttctgctatgctaaaaatgatcaatgaccagcaatcttgatggatagaaatgggttagccagtaccatgagaaatggtagaattcaatttggttaaacttctttttttgaaatcttgtaataatgagtggaaaaatgagggaaaaatgaaggaaaaatataattcgctattggcacaaatgggagtccctaatactattatcattcctattctttactcaacttctatcaaaagatctactcttatccgctagcctcttctttctcttatcaagacctggttcatggatctaatcaaacaacaagagtttttcattagttaaatgtggccatttaaactttcatgatgcatggcattgatgatatttccattttgttcttcacacccttacactagcatattccatgaaaataggaagggaatagcatttacacttatcaaataatagttatagggggaccttcttctgaccatcaaacaatatgttattcttgaaaaacctacaaaaaaaactctccatataaccagttatgtaacaaggtttgcagatacccatgtgtagtgttccatatcaagcaaccatactatactagtactaaaccgatactcagtatgttgtgcatactaagtgtcaatatgccaaattgttccctataccatgataggcatactaagtgtcaatatgccaaattgacctccataatgagcattgctgaaatatactaatatggtaccagtatagatctaacaccatgattgaaaaacttcctccttaattataggaggcaagcatctctccacctataacaaagtccttggcaataggagatgtcctaagttatgtttggtagaatgctaaatgttgggtggatgtctggcctggacaccacctttcaagaccttttcagtaccacgcgatgcagcaggaagaaagaagaaacaaaacaaaaataaaaaacaatcaaaatacgtgaatctgacacaaaagggctcgcctccacggggcatgcaaacttcactatgaaaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacatctagactctgtttcatattggttgtctgcaaggttactcattgatttagatattcttttgagaaggattagttgtcaggctacaacaaaaagaccttgatagctagcctttatttggaagaggttaaggttaacggcgatgatttatcatcataaaatacaggacaatcaagcataagtttgatgccgtggaagcatcataaaaatattaagttggtactgcataggtggatcaaggtggaggacttccatgaaatgaaaaggaaagccaaaagtcatcctcttgagaatttaagcatctgcattggaatgcaagtgaaataatatagcttcttggacaaaggaagatctccttagaaactagtcttgattttccttactcagaggtgctgagaattgcagttccaggaagctcttaggtgaagtataattttgtttattctgaggggacctatgatactaccttgaatctcattcatttttcatgcaaacaataaaacgcatttgattcattcaacccaataacaagaattcagctggcagcttgagtcacttcttgttccttttacaatcatctctgcctatctaatttcagcctacccccttttcattggactatgataccatatcagctgtgatacattcttctgatagaatgcactttgaaaaggaaaaggtgattggcttgcttttaggacaagctgcaatcaccagattgcataatcagactagcaagtacaggaatcccattcatctccaaaaaaaaaaaaaaaaagaaaaagaaaaagaaaaaaagaaaggaagacctgatcaggtgattagaaagatgtaagtttcaactgcttcattttactgagaaacttttaagtaggtgcattagtatcttcatcaacaatagcttggtgataacaaaaatccaaactaaatacagcctaaggcagcttcaggaccctagaagtttagggctcttgaatgaagtagccttatagactaaagagccaacgaagcgaagctgcaatgacatgaaataataaaatgcaacttaaaattttatatgataatttccttccataagttgtaagaaaaataaatgttgtacacctttggaaatttggaatctatatgatccactacatggaatagtttatgaagcaagtaatgagtatttacttcttagagttagagcagtgccgacaatggaagcacaggatacccatactcagcgatgagacagccaacaattcttaccacaaccaaactaagatatattgactgcaatgttttctatgctgaatggttgttttgatcttagattcaaaccataggagcgcaggatacgctcagcaacgagacagccaacaaatgttacgatagccaaactaagatatattaactgcaatacaatttttttgttctgaattatgtgttgatcttaggttgaaacaacaggaccttgataaccatgttgtggtaaagacttcaaagttttgtacaaggctgaattttcaccaagtcttcagtagatagcactcacatatatcggtgcatgtgtgcaatttctttatcatacatgcacatagaaacacatacaggaacaaagaaatgaaagaatacaacaaaaacttcttctttttttttcctttttttgatgattgaatacaacatgcacatagaaacacatattggtgcccgtactatttatgtgataaagtcaccagaccaccagtcccaaacagagatcatactcatcaaagaaacaaaattgggaaggaggatgagaaataaagatgttgagatgctgacaataaccacattataaaacaacagcctaattcaagacaacaagcagaaaattgcatgacatgtttatgtcgaccggagctttatatttttggtcttttatttgatccagtgaaatgggttcttatatcaaccagtcgttgtgcttcagactatgtaaagtatatacagcaccaaggcaaagaatgtccatccttttattttaaataaattggcttcaaaagctccaatctattaagaacatggtctcaatcttcaggcactttttcttttttgcgtaaagatctacatgcactttaattgtgtttataggccactcagttcatctccagtgtttaaattatctgccttctctttagttttacctcactgctggtagaatggttccaattatacatctattctcttttttcaccgcattcgatatgcatagcataggagaaaataaataaataaataaaaaaatcgagcaacagattaaaaaccccactaccagagattgctaaagatcttgtggatttttgctttgttaaatcagttagagtgaggttggacggggagtagtatcaatggcagcatggatttatccgagactctgaaatgtgagagactgatcatgatcttcatttctgaagactgaccaccatcaaaaactataaagaagttgatacatacaaatgtaatttaaaggactaatgacaaaacttggatgagaatgctgaaagtaataagtaggcatcaacatgaaaagacggaaaaaatattgggcactctactcgtgtgaacatttgtctaactctttacaagtaagaggaggcaattttttgcatgtcggatggcataaaagccaagaccattagcacaactagcatgcctacaggaagcagtagtaacaaggaaggtggtggaggcaatggtggcaggataagcggaagaagtatcattgatgctgtgaggcagatcagtaccagaaatttttctgtgctgaaataactcgatggaaaggatttcccatgattcctctgcgattgagtcctcttatactccaagtttggtacactgcccaatgttgtcctctttactctgctttccattacaccactgcaattagacttaaaacaatgaaaccttttgaaaattgccactcagcatccaaaggccacaaagtgcatttaaattcccaacttggatatgtgaaggcttatcaatctttcaagaggtaagagatctgttcatcaagcttataaattcctctctgacgtgggactttaaggttcttgcaaacttgagtttgttctttgcctttctgtcgcttgcaatccaaatatatttattgaatcatgacccagtatccccaactggtgatgctgttttgtgacaaagctttgaccaactgcaacttaaccgcagacaagcaagcaaagtaggtcctcaaggaaactggtaatccactgctattgagaaggagatagccttcaactttcaaacttcaacctgttgataatgaatggaatatggatccccatcagtccaagaaaattgaagatctaattttcaacaacatattatgtggaaaaaaagatatatatcaaattgccatttttttgacaaggaggagggagagaccaaaaagtaaagaaaaaggaaaacacaaactgggctcttggagttggaagaaattaacatgcaggcagttctattggcatattcttttcctttatatacagatgatgggcagcctgaccaatcaaacccaaaaaaaaaacaaaaaaagaatggatggaaaaataaaaaattctatccttccctctcagcctttggcttttaagacctccccacatgatcaaaatgacacaaaagactcctaactttttgagcaaacataaaacatcgatgccttcctatatgatatgaattagagctttcttccaaagccccttcagattcagacccaactgattctgtaaaaatgctctagagatccattacagtaagagaaacaacaaagaactaagcattacctcagttggatttgctcctgtcaccactggaaaagggacctcctttgcattgcgcagcaagtatttttttccttcaagccaaaatcccaaacattaaagaagaatgacatgtgagatcagcacatgtgatacctggagctccttttattttattctattagagaagtaggagggcaaagaataaggaagaaagaggggtggagaggagaagggtggtagagatgttgtttaatggggaggcgcaattgataaatgtaatgcctcactcgggcaagaatcggagataacaggacttacgaggctgatatggttggggttggctgattagctctttatttatttgggctgtgtgctgagttggtgtgtgcgttagagaaggacagatgcactgtattctatacccaagtgggggcagtgatggggatttccttttctttgttaggaggcaaacttgatattttcaatgttttaaggttcttctcccctggcctccttcagtgactccccaattatattttttctcctttgcccctcaccagggtcaagttctagtaaaaaggatccgggttggttttttttggcaatatcttcaggtctgatcaatgacccatcaagcctgctcttattgatttccttgtaccaacataataatgataataaaataatagtagcagtagtagtaatataagaaataccgggtcccaacagtgaatcattccaaaatgattcttcttggaatttatagtcacaactgaagttgtgggagcttctatattctactgttggcatttggcaatattaatttctccctcatggattgatccatgtaaaatgggatttggtggatgaacatgttcttgaatgctagattagtgcttcattattgcatttgaatgctcgaatttcctcatgttttatttaagatgtcgttaaatccttcggggatctaaatatgagagatggtatactttgcatacaaatgtttattggttttcatcacggacacgtgatcaacacaaatatcgtgccgacacaacacatggactcataggattcacatgatccagagcacatgtaaataatagacacccaaatgcttgtgtaggttcaatgtccccatatggatgccataaagttttctatatatggtgtaacataagacatcacacttaattttcctcttttcctttctggtcaaaattcttttttttttttgtcaaacacgcgtcactattgcgactcgctcctagtttttgacccgtacaaggaaactgatatgatacattgcatcaactcatacaagggagctcatgtgatacattgcatcaatcgatagctactcatgaccatgatatttaaataaaacaattctagaaattctttaaataatatagatcttggtattttgctaaaataaaggttttatagagatgattcaaacaactattgtaatatgatatggtgatatggatgataactcggatgatatatctcaattttgcgtaatctttttttttttttatttggaagctggaaggtgcgggcaagttgcgaggaagggaactgcaatcttttatacagcgtatggagtcacatagggtgggccgacgaccggattcagagttttcggccagcggatgcaattggatacgcgcaaccatgagatcacgctttcatagtatcctcttgtacggtccactgaatgttcgttcccgctcgccttttggcgtggggccaaattgtcttgccggcaccagccttggtgggctccaaaaacttggattgctcttccacaagtaaagagaagccatctctctctatctctatcgtccttgcgtgagaaatattttgtacatcacgaatggtgcaataaaaatgatataaaatatattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatcgaattttttacaccgtctatggtacagaaaaaattttcgttcaacttattattggtcggattatgttctttatttaataaacttatcagcttcatgtttaaacttatttaataaataggttggtttgatctattttgtatcagaaccgaaccgtatctactccaacctgacgtgattagtacccaatctgagagagattcatggttcatccggtgcaaagcagggccaagagttgtacccgattaaaaaaaaaaaaaatgtgcaggaccaagaaagtctagggtcatggcacgaaaggcaaccaagcaacggtgcacctaccagaacagcgcactggcaacgagagaggccctaccctaagggtccgttagatttgaaaaatagatcccatattagattagtatatttgatataaaaattaaaataaagagatgataaaaaaattgatagatctaatatttatttttttaaaaaataaaataaatattataaaaaattgatatttaataaatttttaaataataataatttatattaattttttttttaataaaactgtatatgtaatcattaaatttatttgatattttttcaaattcattcaataaaaaattttgattaaaaaattaagataaatatgatattatataaggagctatgtgattataattattgtataaaaattaattaaagatgataatattatctcaatattaaaaaattattttatgttaaaaaatatatttataaatttaatcatattcttatataggtttatctctaattaaatatagtatttttttttaatattattttttaaaatattttttttaccaatcaaatatagtattttttttttctacaatcatttttgtagataaataattattaaaaattatcaattttatttcgtaatctgatatatcccagcagagagaatgatttcctggagcctccctctctaaactatgttgtaactgagttgcaattgtttccggagcagaagaagttgccgacttaaattattctcctaaaacatgaccaatatctaacatccgaacgctggaaataagagacggcgtgattaatgccatcccatatacggtctgtgccgtggcatcctgttctaatgcacacggagaagatagctcgaaggttttgaagcctaggagagaagacaggaatttaacactaacatgaaagattttaggaatgaatttgcaaaaaccgtttcttatttcatggatttttttcttctaaaatcttacgactcctacttcatggcttacatgcttatagctatcgttttgaatatataataaataaataaataaataaataatttttatatataataaatataaatattaattttttaatttttgaatttaaaaatattttaaaacgtctaaattagtcaacttttatctaatatccaactgtttagcaccattaaattattccaaaatgttggaattgtgactatgacgtaccaaactaaattcgaattcgaatctaattttattctgaagtcccgcatctaattggattctatttttaagtatatacatgttaaaatagaaaaaattatctatagattcctggatggatccgaaattatttttaagtctctaaattttttaaattaaataaaaaatctctaaaatattagcaagttatttttaaattcctgtcgtctacgtagattgattacataggtctatgtttaggttacacgaatttatgctcaagttacacagatttatgttcaagttacacaagttgcttatttttaatatctgattatatatgtatcttagttatacagaaataatttttaatatttaaaaaatttatttaatttaaaaatttaaaatttaaaataattttaaattcatctaaaaaattataaataattttttcttaaaaatattaaatatttggtttttttttttnttttttttttttttttgttcctccccgtaattcgcttagaaataggcccaaccttgcctaatgttggttagcacactattgctagattctagcagcgggcattatttatttatttatttataattaaatagttgcgggatctcaggtggcgcaagtaattcaaaattcaaccctcctttggttgcccgtcgtcagtcgtatccactgctcccttctatttttcctcgatcctttcctatttttcttgtgttcgccagaagagagctcgcgagagatctctcgaggcctcgtccacttctcatttggagctcggtacgatcttcgattggtttctgtacatatttccctcttttgattcattcctttcctctggaaaattcttttttccccttcttcttcccaatttttcaggaaaatatagatcggagatcggaaatcgggcggcattggtaagggtatgttttgctttcttctcgttttagtacttaaaatcgccgatttgatttttttagtagtttttttttttgtttgcattaccgtttgatctgttcttttatctcggggccttctgtagttgattcttcttcgattataattattattattattgtcatttaatggtgttgaaataagagggcagttgctggtcaggtgacagacagagagagggctttagggttggttgtgattggagttttgtaatgccgagagcagggattaatttggcatgaacagtaattgtatttatggcatcaactcattcatgatccaagtagtttgatttagttggaaatatttttaggggactatgggcatggtaacactccattggatgcaagggatggcgatggggctagctgcaagatgcgtgtccttgtaagagttgatctggtgcttgtgcctattctttaaaaagagaaaaggaaaagtagatgaaaaaaaaagaaacatggatgaaaattgtaatgctgtatataaatctcttgttcacatcatcttcaaatcatgttttttattcttccttgtaataaatgaaataaatacagaatccgaccctgcatcatggctcagttagaggatgctgccatctggaattactgcattactcaaaacaacaactatgcccccagaaatgatgtatccatgctcctctctgttacattcttggaccccatctgtgttaacaatctgcaatcatcaaaaaaaaaaaaaaaccaataaatcagagagacacaatgagatgtattgccatttatagcaaccatttatgtaacttttgccattttctcgtgactagctctgagttttgtgcttctattgtcaattaaatatgtccatgcatttattttggcattttttgtgtgaacagtctagttttaatatgctatcgatcgaactgtaactatgtatttgctaccttctaaaattctactttttttttttaattttcagataatgtttgttcatccataaagtgagaacaccattttgtaataattatgaagttaagacaacgagtaagataatttctattaagtacaacagatgagttaaaaatgttgccactaaactttggtctatgtcaatgttaactgcaacaagcttcacctggaagttacaagaaataatgtgaatatgatcaaattgattagtgcaacatggagaatactaagaacttgaataatatgcattgtataatttttcaaatatttcagtaccctgacatttcttcctatccttgcattcttatcaactatagcctttcgaatatgagtctgttctccaatcccaactgggacattgaagccttgcaattttgtccagttctgttgcacctctgtctatttgatgacaaaaggaaaacttagaaagagaaagcaagagcatgtgaagatggttgaagtctagtaaacatcattaatatcagacaacaattctctacatttcacatttgtctatataagctgaaggacatgattaactggtaaagttaccaaactataggtgtgtattgataaaaactgcaaaaccattccacactaggtggagctttaaaagtgcatggtataaaagccctatttgaagcatcccaggtgtaatcaatatgacacaatatatgttgggcatcagcatagataatggataaatgcaaatacaactcatggaatatagtttcaagagtggtcatgtgctggaccaaagcaatcatgtttcttgtatacatcacaagaaataaaaaagaaataagaaatgatttgtgaatgcttcatacttggtaataatcactacccatgatcacagaatcctcaatcactgcttcttctccgatatatgttcgcataccaatcacggaatcagtgatctcgcacctctactcttaatataaagaatagaaacagagcctacttagcatcgaatagatggatgaatatgaaattatggtacttagtcaacattcaattatcatagatgatgtaatggaaaatttataaagacagagcatgattgtaatttattttaaaaatatcagattgcttagacaatgcatgaatatgtaccaattatccatgatgtggatggctacttaaactcaagcagaggtctgaaactttttagcattatgacaatttcatttaataaaatcatactgctaggattttgcatcacgataaaatacctgcattgtgtattgctatttaagcagtgcagaactaggatagaaagatcatatcgtgctacctgactgtcatcaagtaacttcaccccccttgaccactttatacctggatgcttggtcagccaaccagctcagctgcctccatctcctctgcagtcttttttctttctagtgtcaaggccaggcatacagatttcattgcaaaatcgtttttactgtagactaaaattctattcattatcttagctctcctgtgtttcttgatgctctttaggtcctctaataactatttcagaaaaaagaaagaaaaacatatccagtctttgttccaatttatttttttgtaaaaatgttctttcttctttccttgccaaattttctcattctagttaaagaaagtggttcaaatttcgcaaaagctaacccattttcagacatccatcaatctgacttttgtaactcatcaggcagaacaagctagattattatttgttacgagtaaaatctgcttcttttgtaggcctctaaagttaaagcggccacaagacaaaaagcttcttttctttctttatctaattcccccaccatgtcacgcagattatgagacaaatcaggtttacttttggggtattatcttcaattaacttcacctttagctttggtaacatatttgtaggtattgtgcagatgatattttggtctatgattgatggatttacataccaatgtatatagaagaccatctcttacctaagggacatgcattatgtcaaccctctgttaaattatatgtcttcaatgacatacatctatgcatgcttactggagaacatgtcaattgcatgtagcacaatgttatatatttcaaatttgagtatgtcatttatgtaatcataccagttattttatcttcttctttctttttacatgggacataaaataaatcagaaaatgaattaagtgcattctatgtatataatatccgtaaacgcatgtcatgttggttcaaaattttaaatgatgatagtatcaagttacctacatgtagaatgcaaccatcaccaataatgctctcccttatgagagcattggtaagtacagtaggtggtaggcaatgtggcatggtgtagataggagagtttctgtcatggaaactacagcaaaggcgtaggtgttatttggtagagagagagatatctaaatttgtcattgaatgtagacctaaatttgttactgaatgatgctgttcattcatctaagttgtgtactgacttgaagccatgagatgttctccttgcactttcaatgttggcacggtagaaggcttcaatggtttcaacgtcttcccattgtccatcaaacatataagcatgaacctgatacaagagaaacttagaataatggtactactggccctcttgacatagtcaataaaagggaaaaacaaaaaaagaataatgctataggaccacatgaataataaaaaaattggaatgttttcctataaaagtaaagagggagagaaatctggataggaaattcagctgcagataaacaaataatattctgaccttcattcccatggaaattgcacgttgtataacttcacttctgaaatcattggccttaggtaggagcttttctaagagtttgatcatgatgtctctcttgatgacatagattcccatgcttctgccaccacaaacttcttcttttgtagaatttcctatctgaattccatgcataatgatccaaatgatgtaacttgtaggaactagactgtcagctttgtctacttgttattaaagaaaaattcagaatggttccaatctagctccatgcatgcagttctaaagctgaagaattatttctttttaataggatgtggataacaaaaaaaggattcattgtacttcttgtccgtaaattataactagagtgatcttaagtttgcctctttttatgaaagtaagaatggaaaacttactgctgcataattatctcgatccctatctggtgcatgtttgacttcagaaaatttatttctgtgattctgtattaagaaatcataactgggattattgttccttctgttacatgaaacagcaactgtgatatctgctccgctatctctatgtcctttaataagttttgcatagtccatttcataaatatggtgactggaaagaaccagaaactcctccactggatgatcttttattacccacaaccatctcctaacagcatctgcatttccctaaaacgccatacatccatttcagtaatttttaagaacatagaaaagtcatagaagtatatgaaaaatgataataaaaacttctttttccattgagtatgggtgtaactactacactgcaaaaaacaattcaactctagatgttattattatttcctaagcacttttagatgcaagctgagattaaaaggagctgtccaagagttattttaaaaaattgtctcggcaaagacatagggacatggtcttgttcaagaatattactatacagatattgaaacataaaagggatgttggtatcttgctattccttggtacaaattgtaaacttttcatgaattagatatgaaaattgtgcctaaactgctgtataagaatcacgctgctagtgctcaaaatttggcaaagacattctgaagtgctttgtgaaaatagagagatttgaaatggaagtacaaatttcaacaagatattccgtgttatgaaaaggaacgatgatttgatgcatcagtttgaatcaaagatttttgaaatcctagtacctcagtagcttgaatagcagcagctggtattgcagcagattgagttcttggaaattgtaagaaatcatgatacagggatctcgaaaatgataaaaattgtaagatggtgcaactttattgaatcatgtaggtcttgagagatgatatttacaattatggttcttattagcaaattacaactattgacatgcaaaatcacaagtgccagataaaattttacagatttttaggggaataagtcaatcttactgctttaaaatagaaggggaaaaagagaagtattgagcctgatgatggtacagaccttaaaccaaccttgctcttcagggctttggtatgctgtcaaaatttctacaaaaccatcctttccgagcccaatgttagaataggctcttgacagatgagaatttagggaggtggagttgaactgagttagagcatatatcctgataatgttactgttgatgcagttgctcaccacaatgtcaatcagcctgtagtttgctgctattggaatggccccttttgatattctctttgtcaggggatacaactttgtctccgagccatcatcaaggatgattgccagaacactctgtaaccaaatttcttatagaagtagctcatatttcaacatgtgaaagagtgttagctgcatattgtaagatgaatgggattgtgaaacaaattatgtatccttaattttgttccaattactttatggaaggattgttgatatcggtcaacctctaactatgtgcattttctttactcctatggttaaagtccttgctgttgacatgtaaataaatgctgactgctttgtatgttgactgaactatatttagtatatttcaagtgtccgaaaatatttgatgcaaaactcaaaccctgttccatattgtgtcttaattcaactgaaacatatgcttggaattccagttcatcaaacttttggacaccagtggttataactttacaattcatcatccttgacctttttcaataattaaattaataattgtaaccagcagttttatctaatatgtttgaggtcaacacagagttcataatttgcattatttgcgaatgttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccgcgaaaaaaaaaaaggaggacaaaacaaaaatgattcaaatttaacctaatcatatctgataattccagttatgagacagcagtgaagaagctaattgagtggctgaccaaagaacccaatatttagaaagcagagatagaacagagaatacaggtacgtgcctgacttagtggtggattcaatggcatttctttctgagagtggtatgagttggaaatgttaagaccatggaaagtgcgtggctgcttcagtgatgttctaaggaagttaagttctgatgggcgaatggggagtgttctagcaggagatatcaaaggagaggaaagagctacatgcagcaacaccatggcaaactagttggtgaggacaatatgattcactctgcgttcttctttgatttatcccgcactgtgcggtgcaatgcttcaagctagaaaaggtgccagagaatatgttgctttccttcttcttcatcaacaccgtttggactgcaccacctttacgattattaacgtaccaaaacaaaatcttaccaaaagaaaaacataccaaaaaaagcatcacggttggtttctctctctccagtgtaggccaaccttgcagtgagaagcacgtgatgtttcacagagaaggggaaaagagggtgtttattcttctctctcagccctagcttctttcattagtccaagaataaaggaaaaaaaaaaaaaattgtgccaactttatggggaaaagcgaccatggtaatgatgtgctcaactgcaaagaggatgaccactctttgacatgacgttgcggcggtcagaatggggtgttcaccaagttaagcatgtctttgtaggctctcaaaggttacagctttaacaatatctcaatattaattaatcctctctctctctctctctccattttcgttttttcctacgcctgtcctttagaagcatctttaaggatgcaggctacgcaaagaacagatcctatcaagaaagaaaagtactttgtgcaccacgggtggtgcagctccatgcatactgtccgtggtgattgactcccacacacagggttgacgaaaaaaattaatttttacattgcgtccggtcctgtgcataaactaatcactgtaggcagtgcacgtgagctgcaccgtctgcagtgcagaaagtatttctcatcaacaaatgaaaagaatgaatgggacctcctgtgaggtccaacctcatgattagctggcccggcccattggccggacctggtgtgaagaaaaaagcccaaaggcctgcttccattatggaatcaggatagagccccatggaggaggaggtagattttgcctcctcaaactccaaccaatagaaggattttgcttgctataaatgatcctaatggccactcgagaaggggtagagccccatggaggaggggggtggattttgcctcctcaaactccaaccaatagaaggattttgcctgctataaatgatcctgatggccactcgaaaagcatttatcccaagcccacccctctctctccatcgtctcctctctctcttttttgccggtgctctatacttgggcttatcatgccattaccaaagccccatcagaggtaaggcatcgttgccccccccccccactttgttgacaccctgtctacccttgttcctacctcatgtaatcatcatgatcgagatcttaccatgaattgttggaatcatgttaggaaaaatgaccctatttgatcacctgttttagatctaattattagcctatttcaccttttttttcgatcattttctttataggcaatcgatgccctcggccttccccctagatcggtcctcggcctgagtcagggccctagctattgctaagcaagctaggagttgagaacgatcaagcaaagggccgtcattcaaccctatttttggcaatttttggtccttcggccattgaccatcaccctcctatttcccctatttttccaagaataagaagaaggaaaaaaaataaaataaaaataaatatagtttctctttctttgttattctctcactctaatttttggatggaccaaagagtcccacccttacgatttgggttaatcctgatgaaggggtcctgaccatgactgttgggcaatgcactaacctccatcttgaccttcatcggatcctaccatatttggcaatcctcgatagtgatgactgacttgtttcttaatttgatctttgataaaaagattattcggattgattgattgattcgaaccattgagctttacaatttaattggcaaatgcctggtctatcttgattcgagtatgaagctgcccctaatcatacccctagcaagttatttcgatcacttagtccgattgtgcttttcaaaatttttttttatgtatttagcttctaaaatattgactataaaattaattatattttaataactttgaataggagtatctaatctactggattagagtgaaaatttgaagcgaggagagtaattaacctaacacttcataatatattttctaataattttttgaaaattataattagtttattgtatttgtttatgatctttgttttctatttgacaaaatagaaaatttaactggacagtttctaaaattatttttatctatatttatagcatggctatgatatggatctgccgatagggattatatgttagatttgtcgatttataatataagaaattaattttgatatcgaatcaccaatggttaaaataatgatatttgttatctgatatttcgtacactctatatctattatctgaactatgtcactgaattatatggccatagtctgatgttgcaattaatatttatttttaaatatttatttttgaaaaataaaaaaatattattctttaagtcttgatatgtccggccaatgacacaatataaattatgtttgattatcatctgctagcatacttagatgtgttatgttgctcattggactggtgtaactattattttttttcattttttagatcttgaattataacttcctcggtacttagggagcatactagattatttagagcaattagtggatctagttgtcctggtcatttatgtcaattattcttctttttggtttagcttagatttaaagaattttatcagaattaaatattagtaatattttagaatttaatgactcagattatcttaaattattcattgatgagaataattgattgaatttttattaaattaactttcaaggattaaagacttttattattgctctaaaattattgttatttaatcagtagccttgtatgcttgtttcgtctaccttgcaggtacgtggcatttgttatgctttgggtttgaagcgtgatagctatgatattggttcaaagcttaggcaattattgcatgtactgcaggctcaaaacattgagggcctataaaagccctaaaataaggtatggcaacattgatctaactaagccctgttcggccaaggttggttcaggggtttacaattttgaccgggttggagtagatttttattaacccaagaaataaatggatcggttgttttggagcttgcttggataaaggttagtgttgctttctgatgttttctccctaaaaaacttttcttcccctaccttcgtttggtagaatttaaaattattgagttttttataagcttaatcatgccaatttttttttttggaggttttagtttttatcttaaacttcaatttattgtaattaggttatctaaacattgcaattattttcctagatgttacttccatctgacgctgtcatttgacaagtaatgaattatgagaaaaggttgttctaaactcattctcttcttttccctctcttcaagctaaggtttttacttcccatctttctccatttccctccttctttttcggtgactagagatccatgacagacatcactcacaaacttctaaattagaatgaaaataaaatagtctataacttcttgatgttaaattttcaaaactgtccctcttcttgttagctcatgcatgatgcatgaattttgccccatctctcctttgctgaagaaacaacctattggacttttaacaggcctagacgaattctactgttaatgttgagaaagttgcctttccttgtgttttgctgctagaaactttaaaaatgctaaagcatccatgtataggctctgtttaggtaatcttgttttccatataaataggggtgtgtactaaatcagaacaggttttcctcaaaaatttattcattagtttggtatggacaatatataaagatgactaggatgggtttctgatcatttaccctcttcccagtcttcatatgttaaatatgtggcttagttggtgattcgagcaaaatcaaagattgaaaaaatcttctagattaattggtgttttgagttctattatgatacatgaagaccattaacaaagactttgcagcatcgtcggtctctaatcatcagattggaaggaagaaaatagaaagcaaaaatactggtcgaaagaggcaaaaaaaaggggagaagtttaagacaatcttttctacatcaactagttacatgctacattagcgtctatcatatatcgtatgatgatatgtgatcatttctgtcatgactgtcgaatagaaatatttttagttatatggtttgattataattaattgaaatttagaataaacataaaaatcctaaaaagtttagagtttttggcgtaattaagtctttttttgtgcttatattttacatgttggattctagcatctactaagagtattttggggtgtctagaaaatatagaaaaaagaagaagaaatccaaggtcaaagaaaaattctagtcaaatctggaaaatcttattctgttttattttaatttttctaccatccaaatgacccatctccttccaccaaaaagagggattagcctaatagtaatagccgtaggtagcatttagtgatctaaatggatcattacagtaatctaaaattatcgatgatataaattccgatggtgatctaatctccaatgatctaaaatcattatatttgataggctataatttagtaattaaagatctccagatatctataagtactctatttggtatttcataaaaattcaaaatcattgaccatataatatcaaaactatccatgatatactctataaaaatatatttatcaatcatataaaatatattatagtaatatattaaatatatttattaatatattaataattaatatagtctataaaaatatatttattagtcttataaattattaatcccataaaaatatattgattgttatcatagaattaatatttttatttataaatacaaatatttattttcattaaaaactaaggcaaataaaagtaacatattaaatactttattatataaaaattaggtacaataagatatttctattttaatttaaaattatcattaaattataatatgacaataatatgactaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttggaacacaacatatacgagttttagttatctttttagattttaatcttcacttggctgggtcaaacagttcaaccacactggatgtagcaaatcgagcagctttctccgaaatttcaaattactatgcactaacccaaataattagaaaactggtcttaatttgtttaacaaatatttttaacacctttcccagtaaatcaagccaaccctaaatggaggatagcaaggtacaccaaattagatttaccaaaaaaaaaaaaatgatacaccaaattagagttggtgtggctcaagacaaattggccttttttttttgttataaatataagacaggccggattacaattaggcaagatcccaaagcagggcaagaatgagtcgggtcaaagcaggtcaggtttgacgaactgacctcggatttgggtccaggggtcttcgaaactcgggctgggtgagctcgcgaatcggtcatgttcacattgcccatcccaattcccaaacgaggtagcaggtaagaaagattgaaagagcgaccacccactacgtccgggagacgagagtggcagtggagagacgggctgaggtatttaagccatcatcccctccctgcatggctccccacagtccccatagcttcggccctcgttgtcctccgacaacgttatgttggcccagatgctgacagcaagtcccgcatcgggcttcatctgcggctgcaaacatagcggggcatgcagtcgaagtgtttgatgatatgtttcagaaggtagcttatttttttttagcaacataatttggtatgcttgctgttttctctcattatttatttatttatgttttcaaaatcatgaaaactcgaatattttcagtttccaatgagtaagaaattatctttcaaaaaaaaaaaatcataattcatgtacctcgattttttgaataaatgaggatgaagattgccatatgttgccgttttcaaacttaatgcgttgcttacggcttttgatgcattttatccaacattgtcatcttcccacacactgatcttatagaaggactcacccaaatctcggcttaaagctaccatactttgaattggatttcttgtaagagtccttcatcttattaataaaacttatgcatactcgagtagcatactcgagtagcaaaggaaggaaaataagaaaccccaataaggagtcaacttctataatgcaatggtaggctccatgctgtggtagaagttttgatagaaggattttttgtgagagaagagaattcaagagaacaggacaataagattgcttcatgcaaacatctcctactgcaatacttccacaatcatctacttttatcctttattatttcgttcttatcaatttttagctttagttacatgcatttatacatgagtttttactacttcactcaaaacatacttcaatttattgtaggtttggatcaaatattgtcattaccatcatctaacaaagagatgccacaacaccatcaccacaaccccacaccagcccaactctaacctccactccctctacttccacttcctccattcctccccatccctccaccacctctgccacctccatgcccgcctcctccgcactggcctctacaccgacgccatcctctccaccaaactcctcctcacctactcccagcgctattgcctcctccccaccgccctctccatcttcctccatatgccttgccgcacatcctactcctggaacatcctgatcactgagcttgccaggtttggccttccccataaatccatggacttcttccttaggatgcagtcttctagcataccggttgatgaatttacccttccaccagtcctccggtcttgtgcccttttgggctcctctcctgccagcatgtctgtccatgccctggcagtgaagttgggtctagaccataatctttatgttggctcggcgctggtcctttgctacaatggtttgtctgaaatctctctggcacgaaagctgtttgatgaaatgcctgaaagagatgcagccctgtggacatcgatgctgtcagtctatgcccagagtggagagccagagttggctttggggttcttcagggagatggtgagtgagggaattcagttagatggagtggtcatggtcagcttgctattggcttgtgggcaactagggtggctaaggcatgggaggagcgtgcatgggtgtagcattcgtaggttcttggggctccctttgagtttagggaatgctctcatagacatgtatgttaaatgtggtgcatttggctatgctgagacggtgtttagtatgatgccagctacagatgtgatttcatggagtgctttgattttgggtcatgggttgaatgggcatgctagtgctgctctaaagctttttgacgagatgagtgaggaagggatggagccaaactctgttacctttctcggtgtgttgtcggcatgtgcgcatgcaggcatggtggaaaaggcctgggctttctttgataggatgaagcaatgtgggattgagcctgaattgaaacactatgcttgcatggctgatgcattgggaagagcagggcaattggtggaggctgagatgttcatcgaggcgatgcctatggtgcctgatgaggctgtactgggagccttattggcaggttgccgaatgcatggcaatgtggagatgggggaaagagtttcaaggagattaatggggatgagtccaagtaagagcggttactacatgagtttagcaaacatgtatgtggatgctggtagatttgtcgatgcagagatagtgagggagttcatgaagcagaagaatgtgggcaagctgcctgggtgtagcttaattgaattggattttccatcattgtcaacattagagtagactgtttatatgtgatacaatcacatttctacctatcttcttaatgaactcatgtgcgtgcatggaattttggatatctgcttggtggtgatacctagaatatgaatgaagggatacaggaagttaactctggtgttgggatcttgagggacactgttaaagattggtcaaggcagcatgatgtaaacaaagcaagatgaatgaaaataactgatgtcaacacccagcaagcagagcgagcggttaagaacacaagcatgtagtacaaggtatccatcatgagccattatgtgtgatatagatggtaagttgggactgttaagaagttgaaatgggtatatgcattgaaaatctatgtaagttaatggaaaagatattctaatgggtcttgggcctgatagaatatttaagtgtctctgaccaagaacattatttatgatccggagcaattaaaagagacggatggcgacttacttgaatctaaactttacagatattaggagggtagccctttgggtgtcaaactggaatttttagtgggcaggacctctttaatcatgagatgcttttctctggattgtgcattggatgtggatcaagcttgggaagtatgtgaattctttctgttaaagttttagtcaactgtgatgagtaggtggaagctttactccaccttgatgatggattgtcaactagatgatgtttaaagcatcagaagtctaaatggattgccgtattgctgcagaactgctacagccatcttcttggaaacaagttaacaagccatgaaaatttttggaagtccattgaatttgccctaccattttcctttaactccaaataatcatgagattgattccttgtgactttctgcaagccaattaatttgcacaaatcattttgttcatatactgaataacaattaatctttaggttattctaaatatagttcaaattaaatatctgcagttgcctgtatgatcatataaagcaaattcctgatatgcttgtcgtccgtttaaaatagagcttcaactctatttcacgtcatctgacatggaaatgatataagcacaatatctagagagagaaaaaaaaaagaatcaattgcattttgcaatagctttttatatgcttgtttagcaccctccatccaatcatttccacaaaatgagcagacatcatttgctggtatttctttccagatgacaatgttaggtaaagcatcatcaagccatgaattcagccaagatcatgcttgtcacaaaatcactttctgacatttaccatcatcttttttttttttattccagtttgagattaatataaaactctaggtcagcattgcattccatgtggccatacatggtgatcaactacaaaacaaacaagcataaacatggtaaaagagagaatatgatatgaaaagagagaatgacgtacaatcaaggttaataaatcaaaacataaatcgagtctcccaaaaactgccataattttttaatggtcaagttaacatcaaaaagcaagacgatgaaattgcatcatgcaaataaatacaagaggggaaaaattacaaggaaatcaaatgcacaataaaaccagtgaaaagatcatagaaaactggagaagaatttagataaccactccttgcgcgattctgaactacggactagaaagatctttccctcgatctcattctttaataagtattcaagggctgttaccgacagtcgctcattgtaatcgcatgcttttattgcttcccatatttcctcactataatttctaggttttaatgtctttatcgcatcgatcaactctcctatcttcataaccaagctctggatgtcaacatctgcaacctcttgcctcttggtcctggaggatgtggccctcctacatgagtcaagtgagggattgggagatgcagcagctggagaaatggctggctcttgctgacagtgacctctaacctgattgcttgaagactttgcaacctgttcaatatcaactagcccctgcatattcttctgatgttgccccttaatttctctatcaatagatccaatatattgatttttatcttcagtgaactttccgttggcttgatcatcaccacaaatgatagctagctcatcatagttatctataggattattcagcaaacaagcatccctaggatgagcctgcaaagcaacatattaaaaaaagaatcaaaataaactagctgtcctgataatagaagtgtagcactctaatagcaaagattgttgcttacacgcacatgatcttggtaagcactggttcccaaactaatcatcctggcaacaggatcccaactggctccacttagacatttcagcctttgtattttgttccaccgggtcttcagagttttcaatcttttttctacatcagtttcatcacattttattttaaatttttgagatacagcttctgcagcagctactagagcatttctcttaaatgacatgtccactttcatgccaactgccacctgatcgactaagaatcttagaagaaacttggacatttccgatttccatttaaattttttgcaagtttgttgacttccactacttggggaagtttgctggtcgcaagctgtttgtgatgcatcgagttcttccattatattctgctacgaaaacagtaccatttgctataagttatttagaaagttaactaacacaatcattccattaataaaaaataaaatcccaactacaactgaaattattcagtaaaatcaaaaggatagatattaaaaactcatatccaacaaataaaaaataatagaaacgagaagcatgattaatctgtcaaatctcaattatgcaaattctcaaaataaacaagttctcatctccatgttctctcaacaatctaatgagcagttgatcccataactaatgtgattttcctctcacagctctcatgacataatctcttggtggcaccgccattatcagaatatgcaactgataacatgctgaaattatagcaactcaggtccaataagggaaaagaagcaagcattctaagatttcaaatgtggtttcaacatctcaaacaaaaacacaatgataattaatggagtgcccataaattggatatttcttttgcattcccagcctgattttcttgggtggaattttcaagtggtaatgtagaccaacaggacgtgaagaaatgaaccaacggttcattatgcatcacatatcaatcaagaagcaagttcatatcaatcaagaagcagttcttcagtggtggtgttgatttatcagtacctatcctccaacctccttatccataaacagttcgataattatcactcttcattcgtattatgcttaatttctacttgatccctttattaaatgaagagaactttcaagtcctattgtgtgcttaaacacaggttagtttcttgccctagatccaacttggatttcctcttccataaacccctaagctcaatttgctccgcatgcatttccacttctctcacatgacccatcagatacactcagtgtcatgttgcaatctaagtcttcgcatgcatcgtgaacatcctatagccttttaagtgtatctgtaagtgaatgtgagaagaaaatggaggggttaaacatgtaatgtgaaaaactagtttagaaaccatcgaccagaatctaaaatttcagagacatgtaatctaaatatatctgcagaatcttcccaaccactttttcacgaagacatttcaccttaaatctagattgtgtttagatgcccaatagctaaccacctcttgaataactttatctattggtacttgccccataacaaactatccagagaacaattttattcactgtttagttggtactcccataattagtggaataaaattgtgaaaaaagtgaaaaagtaaataaagatatgtgttcccctgaaataattttaacctggttaagtatctttttcgcacattgacggaataagtttatttatcactttctgagcagcgttttgactggttagcaggataacttcatatgacccaccatttaaccagcatccaagcagcggctaaaagtcatgagtttgatttggtgcggcatttcagcaaacaaattatgttcctaaactccctacccaaaaaattaagccgaaacaccgcattggaaattaaaaccgcaggaacaaaagcctcaccactccaaggtgcagcctttcagctcccgacaatgattctgccaagttcggggccgccatcgcacttaggcacctcggtcggccgttcgtagcacagcccacggtggcggaaggagctggatggatcgcaacaaaaaaaaattgggggaaaagaacagtggaaaactaacataaatcgggagataaagagctaaggagggcgaaagcgcacctcgagtggaagaagagaacgagatgagggaactctcgggagaatggcagcagagaaaaagagtagatcgagggttccttggtgccggcgaaggcaatggaatgagatggccgagctgggttgctgcaaataaggccatgcttcttcgttccgtctctccctccgatgaccgcttatattggcagtcgggagggcaactgatcgtggccaagcataccgttgaagagagggagggcgctggattttaaattagaaggctttacattatacccccgcaagaagttggtcttcttcgttaagcccttaaggattagctgtatagactcaaactcaaacatgatactgcttggttccagtgttgaatattattatatcatctaacatttagcacatggaatgtgcttgtctgtatgtgtaaaagagaataaaaatgagtttaggttattaataggccctaggcctaaaaccaagttaggttctaaatcccaagcatgagtgggctagcctaaacctagcccaaggatatcaggcttgaatcaacttaattcaggtacgatgttgggctaggctagactcaaagcatgcctctatttaatttttaaaagatttttaatctacaactagcttgagatggaggagagaagggccctctggtgttggagtttctgtaatgttatgaaccattcatccattgaataaatagtagatgaaagagtgatgacaaaaatagagaagaccaacattgtttactcagtctatcccttttaatcatgcattgatgtggtgccatcatgctattgcataaaacatgcatcttttgcatatgcatatatctacaaaagcttcattgccatgcctcataaaattttcaacatcacatctttaccatatatttctccaatgcgatgaaacgcttggagcttagagctttgtccttggtccactttgaccaggatttgattagcggtatttgactgtggaagacaaccaccaaatttattattaaccgttaaccaattacagcaagagaaggtttggatcatgcattggaagggatttatcctgaaggtgggttttataattttgatgtatctggggcctatgctagataccaatattgctgttgtctattttaacctttcagaatatatcagaaattgttttttttgagattttgccatgatacttcaaaatctcttttagtcattttactattgactttttctagccatctattttaaaaaaagatggcactgatctatttattagcaatcagctttatgtatggccgttgtgataaataacttaaattttaagtgcactccaaaaaccaaacagctggcgggatattttgaaagtagtgctccatttttttcctccttcctcttctcttcttcctccgtcgtgataagccaccatcccttcccatgcggagtcaaggtatggttgaggggaggcgagtgacagaagtcgagtgtcgaaggaggagaagaaaggggatggtgggctcaagccgcaaaagaggcaaaaagatgagaaaagcgagcggcgaaggaggaagaggaagagggatggcatgtggctacgagaagatgagcgacagagatggagaaggggacggcaagcccgagcaatagaggtgaaggaagggggtggaggggaggcgagtgacggaggaggagaaggaagggggtggtgggcccaaaccgcagaagagaaaaaaaaatagagaagctagcggtgaaggaggaagaggaagaggggtggcatgtagctatgggaaggcgagcgacaggtggagaagggggtggcaagcctgagcgacagaggtgaaggaggaagggggcaactgatctaagcagcaaaaaagcaaagacagcgaaaatcgagcaatagtaagaagctacaaagaagaaaaaagaagaggattaaaaaataataaattttattttttaaaaataaaatataaaaaataattataatataatattttaaatattttttataataaaatattattaaagaagtgttgtagtaaacactatcatttaacatttgcaggaggtcaaatgctattcaaaatatttttagtgtttaaataaaattgcaattgctatcatgacagtgatgttatcacgaaaaataatggacaaaaatgggagaacaaccatctttctatccaaattattgtttatttaataattttttaacatgatataacgtaacggttcatctccgaaactgttatggtggccgttacttaaaccacattccttgacggagcctgacggccgtctttcaccaaggaatattcccccgccccagcatccctccagtcttccactattttcccagactccctgtactcctcccgcggaagccttgaatgtatttcctaagtttctactccccttgtcttcgtcgcgagagatggagcagagggaggatctgaattccatcctcccctttcttcccctaatcctccgctcctcctccctcttctggccctccaaagccctagaatctcttaaagccctagccctcggcccggacgtcagccacgtcgattccggagaggtcctcttcgacgccatcctcgatcttagggactccatcggcctctcctccgaacggctcgcctccagaaccgccgatggatacgccctcttcttcgacgaggtttctcccctctctcggtcaactcctctttttctgtgttttttttttcatttcattttttggtgctgggaatcgataatccgaagaaatattagatcgagcaatgtgctttctcgtgaattaaagattgagattcgattagttttagtgaaaaatatcaaaaagaggaaaatgatcacggtctgaattatggaaaagtttgtagtttgggagtaaatttaggagttgtttttcttttgtttgagcagctgatgtctagggtggattcaagggtgtggtttggagaggtcattccgggccttgcaaggttgttgctgcggttgccttctcttctggaaactcattaccggaatgccgatgaagtatttggtggacgaaaagctgggctgcgtataatggcccaacaagaagcaggaatcgtatttctaagtcaggtgagctttctcgttatgatcaatctatcaatgttttgcaagaacttaattgctttagatgtgtctagcccatttactcattgtgttcatgtgttttgtatcagttggtttgtttttcttgatggtttagtatgtcctctttgcttgaatttttacctgtctttttttttaaaaaaaaaattaacgttgtttggaattgtttaaaagttttatgggctcccattatgctgacacattttgttatttatttcaggaattgatagctgctctgcttgcatgcgcactgttttgcttgtttgccaccagtgaaaggagtgtcagatatcttccactcattaactttgatcgcttatttgcgtaggccatttctcaccaactcttgcagttgttgtttttctttggatgtttataatattatgcgaacatgctcgccagctagaaaggttctgacattatgcagttctttctctctctctctaaataaaaaataaaacatgctctatcttggttagaacttgcagaggcttgtgtatgtcgatttatgtaattaagaaagagtctgccgtgacagcctttcccactattagaaaatgaaaggaaatggtggttgatatttagctgattagttatgtttcctgaaacctgatttcattggcttatttcaggcttggtagtagagattgatgcaaggtagtcaaagacgaaaggtgcccttaagacgcccttaaggcgcttggggggtctagcaccttgaagcgaggggcgtcagaaaagcgctcgcctgagtgaagtaaggcactaaaattgaggaaaaaagcagaaagtatgatatataaataaataacaactagtgataactattgtaacatgaattaccatataataacaatttaagcataaaacatatatataaaacagtaaaatgctcaactagtttaagataaagtatatgataacaagccataggcagttctaaatttatgaatgaaacaaaaaacataacaagtcctaaaattcatcaatagaatcttataaataaaatagaaaacataaacagccctaaagtggaatcatataaatgaaataaaaaagataaacagccctaaagtctaaagttcattaatgaaatcatcagatttagtttcacttgcgaagttgtcatcactttcgtcttctcttccttcattggatttatatccttcaacatcttcttctgtcttatctgaatcagcctctatctcttcaaaactaactttatcatactaattgactactttatcccctgttagtaatggagctgagaagttaaatgggcggtcttttaggttttttacacttttcagtcattaaaaaaaaatcatagagttcattgaggcgttaaaggcaagtacctcgtctcactaagaaaggctctaaaaggtgctaaaggcatgcgcatgagtgaaagggcatcgcttgaagtatcaaggggtggtgaccccttctggcacctcacttgagcgtctgaggtgcgccttttggcacttttgacatcattggattgatggcatatatttttgcacatccatgctgatatggcataattgcttacattgtcaaaaaatagttgttattgtcaatgttatgagttactgaattgtattatgtgctaaaaggttgtatagctgagccttgagttgtttgctttctgtaactggcacttttttaagttgaaatttgcaaagcttgtggagacatggtaatctcattttggttattacatgatatgcctcatttattgttggcagattgacgaaacaatattttttgccaaagctataattgactccattatcacactttccagggcccttcattcccatgctaaacggagccaggaacagaaaataaagtgcattgttcactattttgagaggatatgcctgtgcatgcctatgggttctgtttcctttgaacggaaagtccttcctctgaaacaaagttgcgatggcatatcatatcctgaggctgctttttggaggaaatctactgtttctctttgcccgtttgaggtaaaattgaaaattgtatttcaaacaaatctaccaagaaattatgttatcattttccctgactttcttaaacaattaaatttagtctcctgagtgtgcaaaacaattggaaacagttttgaaggcaactgcaagttgaacaagtatttgtggaggtctcttgtaattctttgggaaattcctttttccatgggacacaattattttcagatgctccattcccctttttcctgcttgttagacttgagacacctgctttttgtttaggcatctacaccatgatcttgttgctcaaattttgtgaaataaaatgatttttccttcaaaaattgaccaccataatgatttccttttcttgtcaggtcttttcttctggcttgatcgaagaccaacaatatgaagctcttgaagtagattttgcaaatgaatttttgggaggaggtgctcttggcaggggctgtgtgcaggttttccttctgaactttttaaataggtagatgccactttgctctatctttatactcttttacaaaatgagggagatttgctattgcaaatttgttttaaccaatgaaaggcattcaaattctgctaaccaatttgattagtacatagattggaacaaatattcaagtgcaataatgcaaataaaacattgtttggtagaaatgaccgaacttcagtttttatgtttacttaagggtgttagtagtcttttattgattttaagctaacatggtagtcatcatttaaacttttcactgctgaataatatatccttatgtacccccaaaaaaggattaatgtatccttaagcaataaactttagtattcttacttattttttctttaaattaattttatgggctcgatcaagtgaagaaatagaattagagatttatatgtggacacgtatatttcattcttacattcttaagtactttcctagccatgtgctagttgcaaggtttatttgctctcacaagctttcaaacataattttggcataagaatgttacctattgttataagatcatccttgacttatattatacaagtcatactaatgacaaggcctagcaacatcccggccttgggccaattcattcgtagcttggtcttagactggaataattgttttttgcccatagttgtatcatgaacaatataaaaattccagtcaagcacgggttggcccatccttctattatgaggctcaagcacgagcctagcacgaattatgcctaactggttgagtgagagggtagaaaaaaacaataataggggtgtgaagtctggagtataatgatagcatcattgcaatatgatttctaggtagaaggatggtggccaagtggttggatgacagcctgatggtgtctaacagttgttgggtagggattggagaggagctagaactaaagtatcttatatgctaaacttgtgccagtcatggtttgcatgttgaggtatcatatcatacagtgtcatctttgctaatcacatgttcagtcatgtttcatggctaatggtgaagaaaatgggtttatgctggtccatatcagtccgtgctagtcctgcacaggcttacgtgaatcaacatggattagcatgcaatatagaggtacaaatgtctgtattttacctgcacttgtccagcatagtgtgtatcatatggtatgggctggtactgtacagtgacttgatcctttgagatgtccccttgtgtctgtacttttacatagatatcttgatatgtcaaagatgctaatgtttcaagaactggaggggttttttctgattgcttttgacttgttgttagatgcttgttttgtagcgattgtcttaagcatatttgaaagtctctctctgttgtattacttgtatcatgttatcttgctttcttgttatagatttcctggatgtgaagatcaatatgggcatttgtttgagtcatgcacacaaaattttcaacttagggttatgaactaactatcatgaaagcaatgagaaagtctagctagttactttttgctcttaaaagttcaggaaatttcatttgccatgttgccctagactgtcatgatgtcccattatattaaaattcatgcattaatttcaatatttttctttcagacagcaggtttaatttgtgttgaatgtgcacataaaaaatatctccagtaggactttaggatgcatgagactaggtgccactgatatgacatcatcataattacattgtagaagttagacacaattgctggacacccaatcatgaagaaataatcagaaaaatcaagtttctagaacctataagcttactggatcaattttgggcgtggaatttataaaactaatgttccctaggtggctaatctgactataatttacgataaatatgcagatattgattggtatcatgcaggccaatgtatgcactttatagcatgctatttttttataaaatccattttttgatttagatacaaagcatgaaatatgagatgattaaagcttagaattggtataaaatggctattatcattggtttctcttagtgtcatagaaagtaaacaaatgacattgagaaattgaaaattttactgagttaatagatgtaccattatgaggctgttttaggttaaaaattttaagttttggggaaaattttgataaaaacataattacagaaacttgttgtagagctaatggatatcctataatgaatgtgaactcaacctgaatgtcgtaagaaaatccgaatccgaatcagaactctattatattattaggattgttttcagatgttgcttggatccaacccaaatatggcctgtcaaatgttcttcctacccactcaaaaaatgtgaaaacaaaaaaataaaagaaaataaatattccttggaggattgatgttccttttcctagcaaatatgaccaagcatttttctttatttccatggtttgatctcgtcgaagactgatgctgttaatgtttcgtataaatgtgccattggttttcttttcttttaaattaaatattctttcactgtcatgtttatgcaggaagagattcgatttatggtcaacccagaattaattgttggcatgcttttcatggcttccatgggttgtaatgaggcaatagaaattgttggtgcagaaagattttcatgttatgcggggtaagttatttttatttaattttgtaaaagcaccaaggatatatgttgttggatgactgtttggctgagaactaaacataaaattgacatggtcctgtatagagttggtgtattggtggtttaattgaataaactgtttttgcaaatgaccacaattctttttgtgcttaaaatattctcattcatttccaaaaatttagatctttatgcagagttcttttagtgcataatgctgatgtatgttcaataatgaggtgtttctttccttggattgctaactaaaactgcttgttgtttctaggcttcatctgattaagcagaggaatgatgttagattgatctatggcaaaggaaaacaggtggcttaaattatgccattgaccgcctttgctttgaccataggactgatttcaaagatattgttacttctagaattatttcatattgttttaatttttctgctgttgagtaacttaaaccttgtgcttataacattttgtttttccaggctccacaataacttaattttcctggtttaatgatgtttatctatacacctcttttctacaccttgttcaggtggtaatctttatgtttactggcatcaccttttcttgtagcatgcataatcctagaactttgagtggaggaactgtatgcatctcttgtagcaaactcagcagcttatagagttccttcttagttctattgcacttgtgtcttattgcatgtttgatagccagactaggggaattatgattgtgttgtgtttgcctcctgatgaaggatcttcgttggtctcctctacttctgaaggtattttgggttgattgagctgcaaatcttttgccatttcatgtattgtgttaaaggatttttttttcccctattactgaggaaatgtctgcatagagggataatggttgcaatgtttagttcccattgttgagcttgctagtgtcgcaaatggatttgaaaggaatatgactctgatagtgtattttgggagtgtggactattctcattttgagaacctctgatgccattttttgcaacttgtatcttattgatgatatgcattttctgttttcttagatgtcaaaagcgcctatgaaaatagagtttgaaattttaagttgttattggaatgacacttatcattacaaagccttaaatgtagttaagcttaaaatcaaggttgactgtgttgctaccggagcttggactagtcagccgatgatacagtttggtacacctcggtgccgttctgatcgggcccagtcgacacagagagagggtgaagggagaatgagagaggaagagagagggggaaggagagagagagaaggagagagggactccggagggcagttgagcttgctgcaccactattgagctcggtggaagtcggaggagggaggaagggaagaagaggtaaagggacaagagactactggaggccttcggtggggccgatgaggctgctgcactgctatcgtgttcagtgaagattggaggggctccaccctcctcccgatcgaaataagaatttcagcccctattttgtaattttttttggatttatcatatgaagtcagtaaagtccttgttgtggtaaatctaaaaaaaattatgaaacagagaccgaagcccctattttgatcaagagggcggagcccctcctctggccttcattggcctcggagtgggcggtggccttgctagccctccaaaggccttcggggaacctccttttcctttcctcccactgccttcatcgagctcgatagtggcgcagcgagctcaattgctcttcattgtcctccggtggtccttctccctcttctcctccttgtcggtttttcattatgaatgtcagaatcatcctggtcggccatcggtacggttcgacacaccccgaactgagcagttctaaatcggacagtttggagaactatgctcaaaatagaatgtgccttagataaattttatggaggataagcagtggaggttttgaatgataattggagatcagctatctctatttccaaaggaacacttaaacaattcaaaagatgtcaactttccatgtattatttcaattatgctctcacagagttttttaagtagttctgctctgcatgaacaatttattgctaaagatatttcatcctctgatctaattcgcagaaccaagacaaatagaataggttgttgtttgcagttccgcctctgatattcagttatattgagctctagtgcctccataattggcttaaacattttcttagacctttttttgccttacgaccttatggcattgtggctactggctaacatgactccatgatcaatccctctcccttttttacgggaacaaaggacagtgattaatatctcatgatatgaacgtgacattatgcttgaattgaaatctgcatcttgaagaaaaataaggcaccggcctttggatgtagtgattgttgatcattccagagtagccttcagatcatattaactgccctttgagaaactggaatgctctgctcaccttcctcagaaaaggcaagaatctcaagatggatattaaatgagccctgcattcggctgtaatgtgttactcttgttatctgcagtctgacactatgcatgtgtgactggtgaaacatcatttgtctggccccttgagttgcttgtaatgaaagaagccttccaggtttgaagttgttttcccagttatttgcctatatctgatttatgagagtccttattgtgccagagcacttatgtcaagtctgaccctttactctccctcacccacaatactgagaatatccttctttagttgattctcaccagctgtgcttcaaaaaagggatgctttaaaataacactaatttatctaagatatggcttcagattaaagtgactttattgtaagcatgaatggtggagtaggataacaaatgttggtcagatatgcaaggatcatgatctttctaaaacattaatcatttgattttagccaaaactctttcattatatggaatgtgatatggattatttggtgtgttcacacatgaatttaatcttattttgtattgttatattttttatcttgagtttaagatttattcaatattacagctgtgtagtgattttttgactgaaattctgcccattgtcatggtattgttttataggtatggttcttcattctgttttgtgggtgactacctggataagaagccatgtgattcaatgggcaggagaaagacaaggattgtagcaatagatgctgtatgcagtccaggaattatgcagtacgaagtcgattgtctggttaggtatgccaagcctttattctcggtataatagctttttcaggacaattttttggaaaaaagcatcagctaagaaattgctaagatataccaacttaaagaagcccttttagcactggtttagtcatgctttagtatgttttctgtcttcaggacatttgttgtcatcaaatggtttctagcatgaagatctataacgtttatgctttcatctctttaatatgacatttgaccgttgttcattaaaaaaaaaaatgatctcagcatttagatttcgtaagtgtaacataattgagtcatcctgaatcaataaaagaaaatgcataaacaatcaattcaacatccacaaaccattaattacatgcacggtcaaatgctgatttctgaactcacttccatatccatctaatctaagataatgtagaaaagaaaaggaaatcttaataagcattaggaaaggaagcatcaaggtaatagcaaagaatatggtaaaatcataaaattttggttatggagaagagattcggaattttaaacctagaagttaatgaatagaaaaatgtcaaggtgcaaagcatcaacaattggatcgatgaagctcagttccttggcttacttttgttcctatatgcttaggataaaacataaccaagttgtatctaaaaaatcatcagccttgaacgtatttttatgattcatgcaggaaaggactgcaaggactgcatgtattattgtgcttaaatttatacatttccctggcagagaaggccaaaatagttacatgtttttttttgtaataactctttactctgtcctttctttatttttgctctgtagttcctccttcctgacactcctgaaacatcaagtgtttgacatcatatttggcatgtcttcatggtgcttatataaattatatgcttaggtgagaactaggttagttttgttcctatttcagactccatgttgctgtttacttgatacatcaacatgtcttttgagtgtgtgtcgtttgtatccctaagtagaacttttgttaattgctttcgttacttcaagctttttctctattctttttattttgttgtacagggagactaataaagcattttgtggatttttggatgcttcaaaatatcaacactgctcaaagatttttcaagatgctgatgagaacaataatgaagtttctactgctaactgcaacatttttctggtaagaattatcaataagatgcttactttggttaatcagcaaatatcctgatgaagggactccataaagtgatttaattgggccaagtcccttttctccttttctgctttcttgatcctgcacggtctgtctgattaggtttccttgttcctacacattttggccaaattttgccttttcctgtccatcattaatgctttttttagtttctgcacttaacaaaacaaaacttaaccttgatatcttaaatgcctgcatattttatgtatagaagtctattcttgcttagatgatgcagttgcttattgtggacttgattaatttgatgttgattgcctgtagtaactgcctcaagccttgatatacttcataaacaggtttgtgaagctaatgccaagcaagccaaagatcctgacaattctgaaaacaaaggtgcaagtaacttggacttgattggtaagactgaaaataaaagctgtcaggtaatagactctcaagtggatattgggattgcaactggaaactggggctgtggagcttttggtggagaccctgaaattaagagtatgatccagtggctagctgcatcacaggtattctctttgtgagattctgccgctgtccattgataatctcatttgagtctgtattattggggaatgttgtaaatggtggaatatgggcctgaaccatgcatcttctagcgggaatggcttttcatttctccccttggtataatctggtggctgatgacactgcatagttcttcatattgttcagtatggacttgataacatttaaagtcctagccattcacacactatgcattcttttataaagggttagaacagtaagagttacgagtataaatcactaaacttcttttctagtacattttcttttccatttgaagtccaagtatgacctaattcttgtattcgtgtggcttcagatgtctttagactgtcttagttatcatgtatttttgaagcaaagattatgtagatcatgagattatgatttccccctctctcctttttctttcctcttgctgcaggctttaagacctttcatccactattacacatttggagaagcagcattgcagagattagaacaggtatgcttcctgcttttattgttattatacagtatgttagtttgacattatgaaaatctgaacatgtacagtggataaattcatatttttatgatgtaaatcttgcatgtacttggaaaaatgtttgttctcagcatgaatgacagctctttttcctccctatattgtgagcttaagaccatggtgattcaactcattcctttgttcgaatatgtcttccataactgttggactactgaatgtggtctagaagatcgcagatgcggtttatatttctatctgattaaaattgcaagaaaaataattgtagtggctgatttcattatgatgatttaatcaggtgactcaatggaccttggtgcatggatggacagtgggtgacttgtggagcatggtagttgaatactcattccaaaggttaagaggggagactaatgctgggtttttaacttggctcttacctgatcacagcacatcaaatgacgtgcaatgtatgtctgagtagtgtcattcttcagctggtcttcagaagcaaatgtaattgttttttaaaattttctagttttaatatttatatttcttctaaggcgtgactcatttagctctttttcttttttcaggtgctaaactataatttggctgtatcactttctgatagccatcagtagtctcattgcactctgccaggagtgaaagttgttgggttttttcttttcctttctttctttttttttttgggaggatgaaggagaactggataggagggagggtggggggggatatgtatattcttttgtctaaattctgccaaatttaaaagaacctgcttagaaggattcctctaattgttggggcagtcataagatgcgtgcttttgttttcctgctggcatggaaatatggtgctcatcttcgacatcggtggcttgatatgtgtgctggagaggtatctcaagcaaatgatggataatgtaaagatgatgagagtaattttgcatgaatcttttctatgtttttaaaagcttacgagaagaaatcttgcttgctaataggattgcaagtgctgaattgtccagactgctggtggatattgcgattggcatgcattctgtggaaggtgtggggtttgtggtctcctcatttgtatggacaatgctgtggtgtgctgtttgattgctgggttgcttgtttttacagccagaagtgatgccatttggtcggtagaaaatcgggcagcaagtgcaaacattagcaggggcatgtgatgccatgaagttacattttctttaagttgatatgtagattcagtagatatgtatgtccaagaaccgtgtacttaacaagaagcagagaatggaatagctattcataatgttcctggcttcttgcagcattttgtgatgttggaaggctcccatcaactttttggtttgtcaattctgaacgagataaaagattctgttaagacctactatctccatgtggaagtgatgtgctccagataatagagaagagaaactatgtttggttgcggaataagttgaccttgagtaaatggtagatttatttctgatcaatttgataaaaaaataaattatatatatatatatatttaaatatttaaatttacatcaatatttttttaaaattgatatctgcatgtatatttttataaaatatatttttttggtatatgtatctatatcatctaatattgttaaaaattaacggtttaaaattaaaatgattaaaatattttaatagatagacgtgcaaaaagaaaaatttataaagatatttatctaaatagtaattttatgaggatatttacgtaaatttgaatatttagaaggatgtgtgtataataaatctttaacataaatatattttttttggtttgttaatttttttattattctaataaaaaaaattaatatatacaactaaaataataaatttattaatttatatatataatataatttttttaccaaatgatagatcaaaattattttatctagaaatcaaataaatcataactatccatatttcttctaatatataataatatatttttttaaaaaaatttaagagtatatatataaatagtaattttatatggatatttatgtaaattttaatatttagaaagatatatatgaaaaaaaattaatttaatttttatttatttcatctagatggattcaaaccctcttactctaaaatatagtaatatattatacaatataacaatatgatgataatattatataatatttatatattaaaatattatattatattttatttttatgtaagatgaaataattatgtccatcttataataacataatctaccttatatatttcacaaaaatatttttgataaatatttttaaaataaaatataataaaattataaatttttattgttatataatatttaaattcatagctacgttcatttttatgtaaatattaaatttgaatattttgaaagatatgtatgtaaaaaatttttaaaaaaattatttgataaggagttggggttcgtttggttgcaaagggaattgcctgcaaagtaacctttgttgaaaaaactaatcttctgattatttgcttaattagaaaataatgaatatgaaaaatcatgtttattttcctttaaacttttctcatgaaaaggtcctcctttgccttcttgtgttttataggtttccttggaatcaaatttatcccaagtcgaagaatcgttcatcaatttttgataacatatactttcttcttttattacgtttgtgattttctatcattttggcgttatggtggactaaatgaattcaagaggctttaatttcctcgttcaagctataagtaaagcaaatggatggaaactccttatccgaccggaaaagaaatacggtatccgactctggtgaaacgcattggtgcttttttttttttnttttgttgttnnnnnnnnnnnnnnnnnnnncctcgttcaagctataagtaaagcaaatggatggaaactccttatccgaccggaaaagaaatacggtatccgactctggtgaaacgcattggtgtcttttttttttttgtttgtttggtacaaaatatgtatcggtgtttgcggatctgtttgacattgtttttatttttgcagatcctagaataaaaatcaattagattggaaatatcgaagattttttatttttaaatttgattcagaaatttacagagatttttcatagcaaagatttattactcttttagatgaagagtaaaattaaaaatagcagaaaatttttgtgcaaatgcgatcagtatttcacaaaaatttgtagagtagcgcaaaaaaaaaaaccaccgtgccgttaaacagggggcggtgcaatgctccagcggatttcgtgcttaggttgagtgtggtattgtctcccggcggtgggcaagagagacgagtattgggcttgagagagagcaggccaaggtccaagttaggtcaggagtgggtcaagtccgtctacgttcggcccacttggcatccttatccaatcattgtcgcggtatctggggtactgagaagtgaacttccgtttggaaagccgtggacgcttgcttacccttcgtttatcccacaaaagccaccgagagtgctctcttcttgatttaactcaagctctaccagaaggcaagcaggcattacttctttcttcccctcaactgaagctagccaagagatcaaaacgaagttcatagtatccataattatctctttgctcgcagaatggcgttacaatgtccattgctcctcaactgttcgacgcctgttccaagagaagagacccatccccaagtcccacttctatccgctcgcttcgttcctccgcacccaaagagttacgggagctttaaactctcttcaacagttgctggtggtttcgttcccaggtccccaaaaccggtaaaaaaattctggttcccattgtgttacatgtcgtttcaaacattagctcagaactcatcaaactttttacatgccactactactgcgaagaaggtgagagcttccaaagcaattgacgtagtcctcggcgatgggaaagatgaagaagaccctgactccgacgaggaagaacagaaccctggtaatgatgatggcccgtttctaatgaccgaggaggagagaaaggagatgaggagaaggatcagggaggtgctcgacaaagcaccggatgtggaagaggagactgagccagtccagaggaagataaaaatgcaaaagcttttagctgactaccctctagttgtcgaagaggatgatcctgcctggcccgaagacgccgatgggtgggggttcaatttcgatcaattcttcaataagatcacaatcaagaatgcaaggaaggatgacgatgaagattatgacagtgacaaggagattgtgtggcaggatgataactacattcgaccaatccgcgacataactgcaagggagtgggaggatactgtgttcaaggacttcaatcctctgataatactagttcatcatcgatataaagagtcagttcttgttctcttaaatccacattcctacattgtggtatcaacaaatgtatctcattgaaatcatttcgatatcatatacaggcctgaagagaatgagagggcaaggaatgagctggagagggcagtgcagatgttctgggaatctgggttgccttcaccaagagtaagacatccaaatgcttgtctcccagtgtgagactagagaaagtgatcatctttcacattctaacgagaattatatggtggcagtgtgtagctgtagatgcttgtgctgagcatgatctggtagatgccctgcaggtgtcgggcttccctgaaatcctcttcacacatgcagggaagatactgcaccgcgataaaggtatacaagagcatcttaaagccctgcaatagatagttgaaatgattctgaaagtcatccccttttctgttgtttcagtagttcggacagcagatgagtggtccaaggtaatggcgtttttcttctacaaagcagtcaggccatcattcctcgataaatcagtaggccagaatcgagagaagatcccaactcttaaataggaggagcaagaattgctgaattatagctttttgtttctgctattagattacaaactatgttgtataaaaattgtaatgttgaaagaccaatttactgtaaaacaaacgaactcttggatcagatcttggagcacatcaattgatacagtagttagcttcctcaaatggaaatgtcttttttttcccctcaaacagaaatgttcctccaggtgaattaagtgtacaaaatttcaagtcacggtgcatgtgtgtgcatagaccagctccacctagtagcccttattcccacgtatccttgctctcatgtcaacctgaattgcatcaaacatgtttttagaattcaagaatgggaaataagatatcaaacaagccaaaaaaaatagtaaaagatcagttaatttatcttcgctgccccattaataagcatggtggtgcatataagtaggatgatgatcaatgcaataaaaacttaaagaggacaagtgcatgcataaaatcccaaaaaatgttgcaaatgcaattcattgaatagcttagctctgcactctagagatctatatatatatatatatagagagagagaggaggggggaaggggggggggggggttctcgtcgttctttctccagtctactttgtatttcttctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatattttatatgttaattggtaaaccgatctgggcctacacttgtggtaggccgttctggagaagcccatcattcaacctagccacccgtgggcttcgagctgttgctatgttgctacttcggggtaaggcggtaagcacacctacggtggtcgtcttccagaggtcggctccctcctcgaggccccgaactagggtttacatcttctccccgtctcccgctttcccaccagcaaattaaagcgcgggaagagggaagcgctccccctccccctcgatctaaaacggaagggggtctcgatttaagtgccgaaggagtccaatttcatggatgggaatcgatccaaaagagcatctataaaaacccaacaccccaattggaaggagaaggtattgatcttctgcaccatttcgagagctttggttaattacttttactctaggaatttagggttttgtaatttttaatagtttgtttgttatcatcaggtccattaattttccatgacatgatttttttttcccgaaaaatgatatcctagttattttaatctgataggatgccattatatacatgaatctgtgccttttttttttgttttcttttttgagtcaaatgctacttgtgggctgctttttggtcatccagtcttcggttattctttgttttgagtaagctttctcaaatactgcatcatcccttcaccaaattctaagattcaaactcatggacgagtcatttcatagtttctggatgatctaactgttgttattctcgaattaggttaaacaattgtcacagaaaaggaaaaaaagatgaaagacagttaaacaaatcatgtctccctgaaaacgacaaactcttcttgcatctaagtcaggatgatagattgtgctgttgcagttggtgcattctaaaagccattattatttcattttaacagctaaccaacttttaaattacaaacttattctttcaaacagtggcattgttaccagtccatgttatttgaatttgttcacatttggtaaccaattatagtttatgggtgatgcatatatgactttctcagcagaccctcaccataattttcatgctgcttcttatcactgtctttctcattttgcttgcatattctatctatttcagctttttttttactgggaattcctaaaagctattttaatcgcattgatgtataatatctaattgtatctcatgcagcttaggcaaaattgcctgagaagagttcaagaggagagagcccagttgctttggaaaatcagatcaagtgggcagcaatctctgaataagaaggtttgttatgcaattgctgttatgcttaacttatgccacttaattctacttttgcttttatatcttgttgttgaggtgggcataaaagcagcttcatataggtttcatcctcctgatgagttattaagattgttttcatgttgaacggtttactaatatcaataagactatcattcagtgaagggtggattttttttttaaaaaaaaacaaatactttgatgttatgataattgttctgctgacatagatgatcatcttcatttacatttaattgatgagttagatgagccaatcacacaactgacattttgtgaaaaaaaaactgtatacagatagtcacaagtcatgcataagtatttcagtctttaactccaaaattcgttctccttggcagggtagtttgttgccattacgtgtatatccatttcattagttgtttttcagcttatatcaatgagcaattttcctccaacatattaagatttgagaagcaagcattcaagtgggtgcaattctagtagcacatgaagtcaaagctacatgcttaatgtatttacttacagtaagctcgtcacaaaaaaccagggtttcatatatgtagagaaaagtgtacatacaattcatgggcatgcatacaaagtaattgaatacatatgtggacagtatactggaggaaacatgtcacagtgtctgtgtattatgatataaatacttctaacatcatcctttacattggatggtgcgccaagagttggtatgaagaaaaacagaccagcaatgcaataaatagtggatccactaagacaaagggataaaacaggaaagatagcatagtaattaaagcatgagtggactgaacaagggttggcctgagtgccaatataagggttacgagataattctcaatcctcaatggcaattgccgcagatgaggggtaattacctgtatgatatgtcaatttagctgatgctgtgcaaatgttggccatgaggcaagcttagtttatgtcaaaagaagctgggagagaccaaactggtaatcatgcaatgccacttgctgaaataggcaactcaatagatgttcttgcaagcatgttgtaaacatcgcaaggagcctaaatgtatggttaatacaaatttttcctagatttattgaaaactgcgacctttgcgagatatatgggaaaaaataaggaggttgatgaagtgatgttaaaaaattgctggctaatgaagtttgtaaacaaaatacctcagctgatagagacaattggaaacaatgaaagctggcgcgcaatagaaattgcagctcaaatcggcagttgattgtagagatcttcaggcatgcattgctaatagttagcagcagccagtgatggatctgccattcatgcaaaagacattttagtctcaatgatgccatgctgagggagataaactaccagcggatgctgcacaggaagaaggtggatgactcttgcttatggttttaagtgtggtaagcatggtgtagcatgcaagatgcagaacttactaaatgccttgctagcattctgtgtctggcataacactggctgcctgccagtacttggcatgcaagagtgccagtgtgtgccaatcatgggcaagagctaagttgatgcatcctaagataatggctgagtcaagattgggatgaacatgatgtatgcagagtttgattgaagagagaatggtcatgaaattgagtgttagtgctgaagaagccataagaactccagtcacccccccaccccaagtccatgtgtattaaacaatttggttgcttaatagtgatgttggatataacctggaaatatgataaaaaaagtagaaaggtcatattgcaggttggatcagaaggtgagaactgggtgttgctggaagcacattcaggttatatgagagggcattagagggtactatattgaggcagtgtccatgattttgatagttagtgggacttaatatcagcctatagtagcaataatcttatatatggtcataggtggctgaagaagacaacaggaagaagaatatgagtgttattttaatccttcaggtcatgctttgtatgtatgtttacttgcatcacaaaaatgattttgtatttcaattatatggaggttatggatgaattccttttgttggaaaatactgtagcccgtagctatcaggattgtccagcaaggtcatttgtgggcactagtggaagtcttgagattctttttgttgaactagcttttagccagtgaaggcatgatatttgggtaattatggtgatttaatccatattcaggacagtgaaataacaaaaaagggagggcctttatgggggatgactggcattggatcagtatttatgctataatttgatataaatatgtatacttatgtacttgaagtgcatataaatgaaactcagtgtaatgtgggtgatgacattgtgactagcttccatccatagtggtaggtttgaaaggctctaaagtgctttgaggtacaaaggttttttttgtttggtgagttttctggaagcatattcaagaggtcatagttaaatggtggtatgaataggtttgctttgaaaatctgagtttgttgcacttgtatattgatctttatactgtcacttgtttcactgagctgtcttcggaagctaaatcggtgcattatcagttcattaatctgttcaaatatttttttcaatgaaattttgttacttttaactcttttcttattatgtgctatacttctgtgaaatttgacaggagattgcggaaactgcattcaggaatatagtttctgatgagctgcagaagattaagcagtcatcttcaagcaaaaaccagataaccttgttccgaataatagtgatctaatatgggaatttgatggtctgcatacaagtagctcaacggaaactgaaagtgaagagctaatgttagaaatggagagagtactttatgaagatctgcgagaggaattgatcaggagaggtaaatctagcaacatgctcctattattcaatttacattgtttattagagtatgctgaagtatacatagtgttctacacatgtttgctttagagggaattacaaacagcattgctatttaatcatgtatgctgacaaacagcattgctatttaatcatgtatgctgacataatcatggctcaagaaacataccagactttgtaggatgatgaggtcatgtttcagggaagattatggagcatttaatgtgtagaagcctaattcgagctttacatgcttggtactctgtatataatattgtgctttgtaagctcatcttctaattcattcataacagtgacttgcacctttgcagcttatcttatttctttccttcaaaatacctgttagaccttgtttcttagtttctctttagaggttttagattccccattctagatttcttgagatattacttattgttcttctcggtggttcttttgtatgacaaaaatgtcaatggccactaaaagaataagcaacaagctctttctttttatgaagcaatgataattcattcaaatgaatttgtgtgtaacttgttgaaaagacttgagcgataaatctgaatcacaatattgtgagtatgaatttgtggaactacatatcgtgccaactcaatatagtttgttaactaaataaaatggtgaggccagtgagatgatatcaaaagttagcatggtgctctcaaatggcttgaatatcatctagcaacctggactattctttcatgtaattggtaatcatgtacaaaatcatatttgtctacagggcaatcattttatgcagcaactgcttgatctattacttgttacttcactctcttcgatcaactgcaggttttaattcaagctaaataatccactatttatttataacactgtatttgcacctatttgaatatgttgttcaaatgttttctgagccttgaaaaattggaacagcattttttttccttttcagtgcacttctgttattgttaagtgcaaataggaccagactactcagactctggtagtattttaacttaagttgtatgctttatagtattgtagttttagatcacatgtagacacatccttccatattacttgataagataatgaatattagaatatctgtatgatagcttttccacgcaactgtacaggtctatcagtatattgggatcataattgtaacctcttcaatgattgctactattacacttagtttggtgtcattatagaactggatatatgttaagcacaaggattgaggtaccatatgttgtcatgtcctggcttgtgctgtatcatatcattacttgacacgcaatggcacttcagtgtgccaaccactggagtgcagccagtgtcttgccagtgcctcgcatcaatatggcattggcgctagtacttaccattctgtgccaaccagcacttaacctatggtcttaactcaagcaaatctgtactgttcatgcagtttctttcaataatcattttctaattgcagcaacagtgagcagttcaatttcttgtttgattataattttttgatgattcatccctatctcttaatgggtggctaattaatcatgtacagagttagaggttcttgaagaagaagatgaatacttagctcgagcagtttttgaacacatgcaacttaacgatgaccaggtacgaacagcttataagcaatctgggtctttattaaattatgagcaactacatcgcgatgtcacttctttcaaacaatgctatgtacagaaaccaatgcattatttttttatattttacttgggcatgctcatgtggcaaaaatgtgagttaaatggactctgctcaaacttgtggccttttcattttgtatctcatgtaaaacctatgcatgctgatgtgcatattcattttttttcttaaaaaagaatacattgcttgctgttgatggcatgaagagtaggctcactttcacaggtttgatgccatattgtccaagacatttagagattgtttggatgtctgggcccaaaatcccatgagattcatgggttgggccagcttagctaagaaaaatgagcttgggctaggcttgtattcacaaatatctccctatgagattcgggctggcccactccaaaagcctctcaatatttatgaatacaagtctagtctaggctgattttttctacctatgttggcccagccaatgaattccatgggattttgggctcaaacatccaaataggcccttaggagtcagcttttctaaattcactcatcattcttggaacataggatgcaattttcagggttaataccttactcccatatgtcatgacggtcttgcagaaagtttccaggatttcaatccaatgggcacgacaccctgttattacctgcttcggttttttggtggggggtagagaatacctctgcgaaattaaacactattatttatccccaatcctaaggcggcattgtttcttctcagattcctttagcaggcaacaagttataattgctcctttgggaaatagctcctctagcctgggctcctctctgttgcttacctcccaaaattttcaagaaaagaaggcaactcatcaccttaaaaggcttgaaggaaatatgtatttctctccctggccataggttgccagaaaagaagacgggtggatcaggatacacctgcccagcactatgaatctttaagcttcaatcaagaattcttttgacatgctatgtataaagacctcattgggtccattgaagctaaactatgactaagctatgatgatgcacaattttgaatgacctcatgcctaatgtgtgtttccctgatgcaaattctgcccacactgacgtgcggtcgtttgtttctaatggggattatgtacattctgatgcagtacaaggactttaatgttgtcatatcgtctgcaagaaaaaggattatgtacatcttgatgtgacagaaggattcattggcttgtgtgttgtcatattgtctgcaaaaagaaaatgtactgaactgttgaagtcatgacaaaattacaaatcttaagaggccctaaatgatgtatgaagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaatatcatcgcaaaaaatttttgcgataactttttacgacagtaattgcttgcatcataaaaaagcatcatataagatgtatttgtgacatttatttgcgatagaagataccgttgtaaataactttttgcgatagacccccgtgaccctcattctccattaaatgattaaattccatattgtcatttgatattaagattccagttgcctcttgtatcattccaaccatatcatctttcgtatcaaaaaaaatctctacttctacagtcttggttagacctagtagaatagtacgtctctccatgataagtccaaatcttatatgtcgtcaaaaaatcttttgtaataatatgttgtttcactatatgtcggtcttcaagaaaacgatttttacacttcttacacggacaataaatctttgcatcgtctgtctgattaacatatgcaaagtctaaaaatttattgaccccctcaatgtatgtaggtgaagtcttttctcgcaaatcaatccaacttttatccatagtagaggccaacgtgaagaagggtccttggtctcctgaggaggactccaagcttaaggagttcatagagaaatatgggactggtggcaattggattgccctctctcacaaggttggtaagagagtgattgagatccttatctcttttccttttctatacgtttcttctctacctgtttaagagggaacagacatgatcttcttttaataggagagagagatttggtgtcattatgtggatgatggtaatttggctggtttgattgttgacagggctaaagagatgcgggaagagttgcaggctgagatggctcaactacctgaggcctaacataaagcatggagagttctcagatgacgaggacaggataatatgcagcctctttgctagtatcggaagcaggtgagagacagcctcttaatacaatccagttctttccaaactctgtctccctcatcgatacaaatgtaaatcctataatcctgtacacattcctcagcctgtgacaataattattatataatattatatgcaaaggggaacctcctcacttcctccctgcttaccttcaaaaattctgacaggatggataacaaaaaatcaattagatatatctttttttgaggctgtaaaacagcacaaaattatcagaattccaactaaaaagaacctaatgaggacttgcaatgatcgaaaaatcagaacaataatcggaagaaaaaattaagggttaaacagagatcaagactggaagatggaacaaactatatattcctcatttgttctctctattcggttgacatcgaagagggagagatcgagaaggagagggagggatcgtacctgaccgggctggggcacgccaaagagattggggggcatgccgtggggagaggcacgatgaagagatcgggggggacgtcgaggtttggagcggcacgatgaagagatcggggggcacgccgaggtttggagcggaagaaggggaggaggcgcagtagggtttggagaggagaagaggagactacggtaggagaggggaagctgagaggtgagcgcgggcggtgggatgggattttattttatttttcacggtacaatgccgtcgcaaaaaaaaaacattaggcgccatgttaaaaagtgtaggcgggaggttttttatcacgacaaaatgccgtcacaaacaaaatataaaaataatggttcgattttttactactgtaaaatacagtctcaatatatatatatatatatatatataaattataaattatttaccacgatccactatcgtggtaaaaatcgtagattatttatcacggtgtattgccatcgtaaaaactctattttttactacaaaatttgattgtcgttacaaatagtaattaaaatttatatcttatttacgaagaatttttaccgtcacaaataaatttttttgcgatggtaaattaaccgtcgcaaataagttcgttgcaaaaacaccttttttttgtagtgtttattgatgataattaagggattcgctaacctttcttaatccacttgattgaaaaaaaagaagaagaagtgggaatcctagatcatcccattattgagaaaaatttaaaaagtgtgaagatttttttattaatcttaagtggcttgtacaattatgtgccgtatattatgtattgttagacaagagttggagtgtagggaagaaggtatcacacgtagtcaatgataacttccaaacgggttaggtaaacgaaggaggtctattcatgcacgactctttctacaaaggctctctagaaacgtaggtgccaagccaaagtcatgggcaaccaaccccaaattttcaataacaacctcctcacgatgtagaaaaatagtgctaccataatggcatgctggtccctgtgatgaaaggaatagatacgtaaatagtgaccacttaaaaaacacaaaaaattttatcccctgaagccttgttaatgaaaaattaataaatgactcagcagtcttaattactgtttctacgtgtatctttaagtttttatcgttcaatcatgcttgagaagttgttgccttctccaattcaaaggaggccacagtttctgcgctggtttgatagaccttctgtgggcttcactttattctaaaccaaaagaacaaaaaatttgagttacgtcccatggaagttgtctataaaatatgatcatgttaatttctagatctgtagacgtaggaaaaaaaaaaagctcattagttggcatccgtactttgcaggactaaattaatgtcatacaagaactaaaatgccctctgtccaacagttcgtttcctgcgctcaagttggaccagcttagatcacatgcgtggaaggtgtcaacaaaacaagtgcttgcatctagtcattttacacataccaaattaggattaacaaattaatttattagttggcgtactaattttgtagaattaaatcgatctggaacaaaaattttgaaatatatattcagactaaggaaatatttgataactcagctagctctagaagaactttgtcatgtcatgaagaagagcttaatggagagccaaaccagattatatatagctgtagttcttgattttgttcatatgtctcctttttatttttccacagcttctgataaaattctatattctcatcctaataaaatttctttatcactttacaaataactgcaatgccaattaccaatataaaacttctcatgtttcaacttagttttcttgtagaatggtctatctccggagctatccacaagcaaagagatctctttctattccctttcagtattttttatatcatcctcacatgcatattcccaccatatatgagatataaatacatttacaaaagataatgcccaaaagaggcttcaaccttcaagtaattaaccaacacaagtcaacctatacatttcaagagctccctataagaaaagtctggcaagacttccattgccaaccaaacaaaaagctcctccaagtctccaaactttcccatctaccttccctgcaaaacatggaaggattaatcccattcatctgtaggacaatcaagagaagaaggacccggaggtactacaagtgcctctcctccggcatggcgcagaggttcgactctgagagcaacttccatgccaacggccacaagttgctgccaccagtagtaccagacaagcttgaaggcttccatgaagaccacaagagacataggcggtatcggtcaatggaagagttctctagtgatctctactcgccagagaaatatggagatcatcgtccccgtttagctaaggatgtaaggtttgggagtcgtcggttgtttgcatgcatcagcggtgcatagaacgatagattatatgtgattgttgagggaagggaagaggtaattagatgtagatagaactggtttttagatttagtttgtgatgcaagtctttatgttaatgtagtttctttctattaagtgttccttaatttatcctttattgaaagagaaggtggctgcccagccagtctctgtgtctgaattgtagataagaaataatagttctccctgagaaagggaagaaaaaaatactatgaagtattttttagacaaggaaaaggactaattttttcaccatggaggaagaactagtttcttcctttttcctctgggtacgaatgaagtttcaattcttaccaaaatattacagaaaaagatgagttgtttgtggagctgcacaagtaattttcacagagtgctatgtgcacatatttgttcaggcatgttattctctgatttattgaccataaccattaaatcggtagttcagggtattgtgtgaattttttaaattatacaaaagcttcttgtgttataatattggctaatatgttctttaagacactagaatataaagagagtgagaggcaaggagaatatatggtagacatagcaactaaagcaaacaagatgtcagttaatttttatcagttttcatttttctgaaaagcttgtaattaagtttcctgaatgtctcagtatattttgtatttctcagttttcttgatttcaaatacttacaataatcttgatgatttatggcatagagcttatgctattgcttacataacaaattgagctaagattggaaaggtggataattggaaatatatccgagctttgcttaattttcttctcatcatttggtcttcttgttcaaagtaaggccgattggtaaaaccattttcttggctcaagattggctaagttcaagttctattcaagaactctatgatatttttgaagagttttgcatgaaaggttagaaagaaggaagcgctctatctttattaaagaaattatcatgcttttagcactaatgctgtgaacatatattatatccatagtctaactatgttgttgtcattatatgatggaagttgcgccaacaacttctttatttactaagatagtggttgcaccttcctagatcttgcaggtgaatccttaaatatttggactttggtaatttatgtcatatgggtctttcctctgaaaacagacaaggacaaagatttacaaatgacgatcctcatgattatgctgatgaaaagaattttgaaatggacgatctctcatgatgtttcctttgctgatgaaagcatgatattgaacttttttttaccaaagttgaaaacttatatatatatatatatatatatatatatatatattattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatatagaaactatggatggatatgccaatcataaatttggaatgcaagtattgatatgctaacttgttgatggttatcttttggaatagtctaaaaaatgcatatgttattggttgtatcctttctgaaaaagaaaatttttttgtacaccacaggcggtgtaaaaaatccgatgtggagtacaccgctttgtccgattgatccacataaccatcacttttcaatgtgtatttaatgcctacagttctatttttttgtttgaaattttgaatgataaaaatattcctcctctttgaaaaaaattatgacatcctatggtatattatgatatcctacgtcaaattattttttacacatagaatgtcataatatggcctaagatgtcataatatagcagggacatatttatccaaccacttttcaacacatatttaatgcctagctacaattttattttcttgtttgaaattttgaatggtgaaaatacctctcctttttgaaaaaaattatgacattctacattgaattatgacttcctgcatgcaggatatcataatatatcccagaatgtcataatatgtgagggatatttttgcatttattgcctgtagttgtatttttaatatgtatttattgtctgtagttttatttttttcgtttgaagatttttaataacgaaaatatctttatttttttaaaagaattatgactttctttgcatattatgacatgctgcgtcaaattatgacttcctacatataggatgtcataatatggataaaaatatcataatttttaaaaaaaatgaaggtatttttattattcaaattttaaataaaaaaataaaattacaggcgttaaatgcatattagaaagtagtaactacgtagatcaatcagataagatagtgcgctccacatcggattttcttttgggcgcccacggtgcataaagaatttctcttctgaaaagatatatctcttagtagcagttgtattcttttttgcaaagaaagaaatctctcttaataaagcatctcattgaaaagcatatttcttagtatataatctatcttttggtgtgcgagattctgtgtgggcatatatttatcctacatcgattatttctaggcagatcttggatatttatacaagactaatcaatccaaataatatcttctgactatttttttagaaaaaatcctgagttgttacaaatagtattagaattgatctagtccatagtctatgtggactaaagaatactgcagtatgggttcagtaaggttgaccacgagctaattgtggtatttatgaatggatgcatggatttggaccattaacattatgagaatctcagagcttaaatgggggagtatgtgaggactgtgcaggtatgtatctagtcctatatcgattattcatcgaaaagattttgaatatttatataggaccaaagaacctaaataatattttctgactagcctttttgaatgatattctagattgttacagattgtctataaataagtgggatcatttaggagttgtgtggccagaaaattatgttttccaaggatacttgggtaaaaatcttcaagttagcaatttattcttgaggttatgtgctatcaaccattttcttccaacaagaagttctatcttatatgattgaaaattggagaaactaaatagcatgaatacaaatttctattataactccacttaacatcaaatccattccctaaaatctacccccaaccatcataactattttaacatattctaagagtttatctacactagaaattatacttaaaaactcttaaagtcatttaaatgatatgaaggttttatagcaacctgtaattgtgatagtagcatcattcaatggtataattactatgtcgaattatattatgttaaatagaaaactacattaatcaagcttaatatctagtacattatgcatttgattttattggatagactaactaccttcatcaaggtccgaaatttttagattattcaaaaaagactaccaccactggtggaattgaaaaatattctatcttatctagacctccatcctttatttgattaatacgtatatgacatgcaagtataaagattcaaacgctcatttctttaaagttaatattggatatataaagattttttctcgaaaaaaaataatctgataggaagatcctgagcttgatatgattttaatgtcaataactttaataaaattaaaaatttgctttatcaaaatttagctcttctattgctactattaaatattatatttttcacattcgaaatatatgtcattcagcaaaattggttcagaaaagtaactcaaattagagatttaggataaaaatagagatttaccttaaataagataagttattcccaatcaagtaataggaacaaaaaagcatgatggattacaactatgcatcttgattttcaacttgtaattgagcctttattgagctagctctagtttaactttatttaaacacatgatcaacctactctaaatagactcgtatgtaatagttaagtagtcatgggttctaattatccaaatgaaaaaggaccttgaatcatgcttagattgatcgacttaatttagtagtagtttagcaacggttctggataatgttttaagacttaaacaagcaagctagagcattcttgataatatttaagacctagacaagctaactagggcaaccttcttgacccataatccgaaagtctgtatttggttaatcttgaacatctaaatccaacaaattccatcaaacatattaacctaggtgttccaacatgtcattctctccagattttagaaatcattataatattataatcataatctttactaatttcattacaaaaaaatattcatcgataatagttttgtattgctagaggtgcctttattataacaaatatcaaaattattattgacggttataataattataatggtcattaattatttcatcctttattagttgaaattatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccaagaaaggtgtatttatgttaagagttttttacatgtagatctttccaaatattcaaatttatgtgaataccttcataaaattactatttacatatatattcctataatttttttttttgtcacatctatctataagaatattttagttattttaattttaaactgttaatttttaacggtgttagataatatgggtacatatgcaaaaaaaaatattttataaagatatacatgcagatattaattttaaaaagatatttatataaatttaaatatttaaaaaaagtatatatatatataattttaaaaattaattaattataataacaaccattgtaacttgagaatgaaaaccaaacaaatttggggcaaatttatacaattttaaattttaaaaatattattatatttaggggggaaaagaattgttgatatatgtcacgtaacagccagtgtttaagtacttgtaattattgtggacaagttatctggcttcctctggaacggctaatattttatatcagggttgtttccaatggcacaccttagcccaactctggtacgatgagaccaacttcgcggaaggttcatggaaaggtcgtgggcccaatatatattgcattgcacctttaaagtcttagcccattccaacaatattataaccatggcccaccttggccttgcagcggtctccttactttccttggaagtacttttttgcctttttttttctcttttttttcaaatatatgtatgaatcgtatatgactaccatagatacatccaacaaatcagaaaataaaataactctaagctaaaaagggatagtagcaatgttcatccgtgtcagggattcggccttccatctgccatatatcaagtccattgcagaagacaatgttcagtggcatgtggaagcaatgtaacatctgacacatataaggagttgggcttcatgcaagatagcagagattatcttattactttaaccactcacaacttaccacatagccaatttttacaaccttggtttaggtgatcatacttcaaaattttgtttcaatgtctcgcacctagagctgatcatgagccgagctggggcacttaaatgtcaaattttaaataggctggcccaaatatgactaaacaatgaatatagtttaggcccgaagcccgcccaataatcaatcttgctacctcttgttcaagcatatatttgctttaatctcaacaacgtggtatatatatattcaacttttgcatagttataggtcattttaatagcctacaacctatattttaccctaatcccaatcttgtctgatttatttgtcggcatgcaactttgagtggaaagagattttcaccatataatcaccatattactgcaactaatttttagcacatgccacctttaattcttgggaagcatatcatttcatgtatctaaataacgtggggtgttttaaggctatatgcaactacaattattttatttgcaacaaaccttatcgcagcttgattttctcaattttgtataatctattatttgatgtgcaattttaaatggataaaaaattttattttatgactccggtcagtcacaaaccaccatgtagtcagttcccacaactttggttttaagtgatttgacactgcagaatgtttgtttcggtgcctcctacccccaatatgtcaagaagcatatctttacatttatctcaacaatgcagcatgtatccactgcttgcttagctatagatcgttctaacaacatgaaatgttaactctagcctaatcataattggtagaagtcgtcggtatacaactttggatagaaagagaactcctccatgttatttcaacagtaatgtgctaacaagtattcaattcctacaatttgggttcaaacagtttgatacttaaaattctcttaagtttgttagattcatttatccatatgcagctttaattgaaagttggatcttactcattactctagctagtcacaatggaacatgtactcaactccaacaatctaggtgcaagtgatttgatactttagaaccttttttttttgtgtctaccacctccaattcatcaaaaagcatcatgtggtatgcatatcaacaatgtggcatatattaattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatatgtggtccaagttgagcccattagaaccccaccacaccctgcccagataaaatgcactgaaagtgatttgatttcagagccctacaaaggaaagccagccctcattgaactttttaaaaaaatccaacctcaccaatgttttttgtcacactaacacatcatcaaaaacacgggcagcatgctcacggtcggcactaataaagcagcagcaaaggagagagcatccattaacggtgctccaaatggaaagcaaaacccaaaccaaataaagtaaatttattgccggggtaccacctttccgttggaaccacatcgcagccgtcggattggacgcgtggcatgcatcaagcttttctgggattgaactcttccaacgagtactgcacctcggctgagctcctccatctctcagacaaacctctagaccctcccccccacctctccccaccggggataaaaatccttccttttttttttttccacactttcttcgctcttcgctctcggaaaatctagaggtttagctgtcggaaatccattcgaagagttcgtcctgggattgaggtttggtttgcttcacttctctcgttttctcgatctttaatctcttctctgggctccggaagagcccaggggaagagattttgggttttatttcttttggttatcacctgatgcgtctgaatcttgttcaagatccagtgctttccccctttttctcagctttgttcgctttttggaaccctattcgcatcaaaaattcatcaaaaatcggatctttcggcgtttttttcgatccgttcgcatcggaaggcattgaagaatcgaatcctgtggggtttttttggcgtgtaggaaatgtcgtacccgctggagcagcaacagcagcagccagcgccgccctcgccggtgtacgacgcggtgtcgacggcgaacggtggggggtcgtacgggccggtgatcggcgtgctcgccgtgatagcggtgctcggagtgatcgcggggatcgtggggcggctctgctccgggcggaggatattcgggtacggctacgacttcgaggggtggatcgagcgcaagtgcgccgcctgcatcgacggtaggttggagctccgtccgccacaggcggcggctgcggcgacgacgggaggagcggggccgggcgcgaatggaagcggtggagctgctgcgggggcggcggcgggaggagcgggggcgggcggtaaacaggcggcgcagaacccggcgaggacggccgagacctgagtgggttctcgagcagtatgtggaatggggtcctcctcctttttttcctcctttttttttattttaaatatttatttgctcttttcctttttgtttatgcttatgttgggtctttggggagtctttgttagtgtggcagccatggcgtcacatttcaaagtgctgggggtgatgttagaacttgagaaggggtaccgtgaaaagaaattgagtctttgttctctctatctctctcctttcttttatagtctcattccgtgagtttgtcaggatgcgtgtcttgtgtgtgcgtctctcgtggtaattatgcaagttgtcatggaaaaaaaaaaaagaaagatcgttatgcagtaaaagtgggaccttttaagaccacttttagctcaaatgaagcaggcagttgcaccacaagataaatagtttaaatatattatattttatttaatttttaaatatttatatatgtgtatatttatatatagtatgtagtatttagtatgttgaaattgttacaggttatacccacgtagatttgtatcaagaaatgttcatgttattagctctatatattaattagatttgggaaatggtatgctcaccaagatacatccacaaatggtaaacataaaaattgtatttaataccagttctttcttctagggaataatatccaccctaagtttcatcatttttttaattcctgattgtcatcatgtgtattcgcttatctctcagtacatacatgattacaaataattttgtatatatagatataagtatgtacaaggatggtataattaattgtgcacatgtacaaggatggtgtaattgcgcacaagagtgtgtgcaatataaattcaagaatgagaaaatcttgtataagggtgtgtaggactacgactaaatacttgtggttaaggaaatacatgttaaagtcagattaaagaaaagatccgatattaagctcttcaaaaaataaataaataaataaataaataaaagtgtcaaaccatttctacatgatgccaaaagagggatttcatctttggaattcccatcctagtatgatccaacaattgggggatgagctccaatgattggtttccattggatcttagtgatgtgatgtatttaagaaaatgaccaactgtgctctaatttttttcattctacctccattgattaattaggaatgcggcaatttttttttaaaaaaaaaatgatattaagcaaagttgacttgttggatgttgcaatgcttaaaatatattgatggaaagagatttaaaactatatttagcgtttgcttggcaaaaatctaacccactttgatgagattgatggaacgagagtgtgccggggatacggaaagacaaagcgagaggagggagagaagggactaaagagagattgtggggtttggagggcccgatcctggaaggattgaaaaatctaaaatggtcttttccttttccctgatttgcaagaatccgcaatcttaacatcaaatgcaagaaaaacttaattcatgaactatatttgttgtctaggctgcactgtaatctaccatattttgttgtgcttgaacaaaagttcagacttaaaagtagtgggtgagatatttttggtggtaatgatggttgatatgagcttcaaattgaagattctatgcgtctacaaatacagttcatgacagttttacataatctatcgtataataattatctataggagggtcatagtgtctcgtgctttaatttttttctatataattccttatttgtctttgttatatgcctttgcctaatccctggcccctaaaacggtacatttatagcatatactaaatataaatgttagattaatatcaaagtgaataaccttgaaaagccagagtcagcatctaagtaaaaaggataaagtataatgcctttagatgattatcagaaattaaagaagaagaagaaagatccacctgcattataattatctagatccaggtaccgataatacaccattcgatgctcgaatacataatctttaattgccgagaagaaaggtgtgataactgagataaaccccaagtcacagtggccaaccaatttgaatgattaatacattttgatgaaaaatttgcaccttccactggcaccacatataactgcatagtctttcgcacttttttttaaaaaaaataaataaataaacataggtctactcgatggttaattactaggcatacctatctaaaataaaggcaagttaagaagaacgatccatctgggatgtaccaatagattactacattccttccattacggcaagtgttttctaatttttatatggtaggctttggttcagaatatattaaaaacattccctaaactgggacaaggggaaggttgtcatgtggatggggatattaaatgcttaagcttttatatccagagcacggcactgatatggcgggggctcatctgggaagagtccacatgattagcttcccgatacggtaccgatagttgtttgttattccacgaaatctactcgaatggttactgcaagctcccctcctcacatctctctctctttgttaggttggtatggtttgaagggaatagttattccataagttatcctattttcgtttggctgcagctcctagaataactcatcactcttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaaaaatatcgaacatggtcaaatgctagtacgattagggttttatctacatcaagatttgatgtgaccagatttccaatcagacggagacaatatctcctccaatcgaggtcaggtgcgaagaaaagcaaggctgatgagacgtgctaaccccgttccttggcttgctccgtggtgcatcaaccaggaacttgcttgcttcgtgatatcattgccaaaattttgtgaccatttcgccaaccagcccttttggttgaggataatctgacataaaaaatatatcatattatataaaaataataaaataaaaaataaaaaaaattataaattttttaaaaaataaaataaatataattaaaaaatagtacttattttttcctattgaattatcgaatagagacaacctgaaatcattatttttttggaaaaaaatattctctaccatatgatattaatattatattatatttaatattaatataataatatattattttaatattttataaataattataaatatattaatatttatcaataaatattaattattaataaataattaataaatagaggttagttaaaataaatctaacataggatttattaataattaaaatattttatttatatactaaaatttatttaaaataaaaatatattttttaatatatgtataattaatttaagatatttattaatttatttaaatatattttaatatttgaaatagctaacattgataatatttatgtaagtggctatagatggctaacaaatagatcgagaaaaaaatattattttttattttttattttaaaatattaattattaaaaatttaataatatttttatataaaattttttctaatcaaatatagtaattttttttctgatgctattttatggagtgatttttctatcaaccatacacaataaaatttctttccttcataatcatttttttagattaaatgattttaaaaattattaaattgttccataatctcatattccccaaccaaatgaacttttaggctcgtaggtgtccaattttaagagataatggctaagttaatctctccttatttcctaacatacctcgcgataagaaccggcaaagagaagcatgtgaaaggcttctatcctgtgtaaaactttgcatgcagtctctctccaatctggaaatgcaatgcatgcattctcttgtcacatgcactccatccatcatgtcgactttctccggccactcgaactgttcatcatgtgtagtacctctccagtgcatgctcacatgcatgtccctctcaagccctcatgcatgggtgtcaccatgaacagctgcattggataatattattgccagcccatttgcgagaatgaacacggcgtgggaaaaggattcgttcgatcacatgaggctatttaggtgttcttgatcttaccttagactcatcttaaacccagttgacagcgagttggttaatcattataaatataatatctataacaaatcaatgatattattgatttttttttataaaaataatattataaatacgaggatcaatgtgaatatgtatttagttctatattagttattcgttgaaaagatcttgagtatttatgcaaaattaaaaaatttaaataatatatctttcaactaatttttatagtgacattctaagttattataaatagtattggatcgaatcgaatgaggtttctaatttattatccatatggactggagaatactacaatacagattattgagattgaccacgagtagatcggagtgtttatgaatggatttgtataaatttagattcttagcccgacgaagactcatgcgactatgtatttagtaccatattgattattgatttgaaagatcttcgatatttatataaaattaaaaaatttaaataatattttttgattagttttcgatcttagattattaagtaaatcttgaaaagatctttgtgttgaatttgcaaaaaaaaatattgaaaaaatctttatatgtccataggtcacacatgtatatccgattgctcgatgaaaaacaaatacttgatggaggtctcgcatgtgaacaacaaaatacacttgcggtagagcacattatttgtggagtgaaactggatagggctacggtctcatatactctgtctacaattgcaaatagtcttgtggtgatatcattctttatgctgctgctgctgctgtcttttgggttacacttgcattcagtcatcctactttgtttttaaatgagaagtaggatctcctcacatgtaagttaccgtttcttagaaaatctccacgtacacatgtaagttactgttcatggcaatgtgtgttggtatatattatcaaggatcttgtttgtaccaggtgaaacattgctagtacctcccactccaattcgtaaatctattcagccaattcatatcataatatttatctaaaatataatactcattcaaaaaatataaaaaaaatattttgattattaagttgaaaaatttttaaatatttatataaaattaaaaaaatctaaataatatctttcagctaagttttttgaataaaatcttagattgttattgtagactttgaagatattgaatttgttaaaaaaatattaaaaaaatttatatttatagacaatatttgatgaaggtctcgcatgtaaacatcaaaatgcacatgcagtacaccacattatttgtggagtgaaaatactggacgggggctacggtctcatatacttcgtctacaattattgcaagcagtcgtgtggtgatatcatctgttgccttgctgctgctgctgtcttttggattgcactttttacccttgcgttcggtcatcctactttgttttcaaatgagaagtaggatctcctcacatgtaagttactgttcttgacaatgtgttttggtattatcaagaatcttgcttgtaccaggtgcaacattgcaagtacctcccactccaatacctaaatctatttagccaattcgtatcaaatatttatgtaaaatatatccactcaaaaagcataagaaacaattttgaaacgtctattaggtctatggattgagtctaggttgtgtgccggaatcattttctattgtgacaagctgattgagtaaagacacacaaagaaaaaaaaaaaaggaaaaaaaaaagagacatatataatatctaaatgatttgatttattgatctatgttagtagatagaaatgatgctaaaattttattctaaaaaattagagattataaagtacaagattttttcataaatctttaatcttatgttgtgttcatattcatatatagttgaattcaagaaatccaaatttcaatcacaagttgaagcatgcaaggttcaatttttcttgatacaagcatgcaaaattcattactgaattgaaaaatatccccttctcgatctggagctgctaaaaaaaaattacagaaactcctactcaactttagctcaattttacttacacttctatattttaaaaagtgtcaaactagtcattctaattaatgtttcaatatggtcaagccattcattttatcaataaacggttgtagatttctctctcaatgaacaaaaatgttctttattcatgaatggacttggaggaagaaaaagatgagaagaaaaaatgaataaggaaagagaggaggggagaatgatcatggataaggaataggttagagaagaagaagaaggataagaagaagaagaggatgggaaggaagaagaggaaaaagaatgggttatcggtaaaaaaggatggaggtagaagaggccatcatgaagaggatagtttatgggcgatttagagaaaaaagaggatgaggaggtgaaatgaatgagcaaaaaaaggaagtagagggagccatcatgaaggagaaaaaatgagtgagaaggaaggggagggaaggatttttttaccgatgagaagaggtgaatgtagagggagccatctaattaaagagatagggctcacgggttggtttggagaaaaaaaagaaagagaaggaagggaaggagaggagaagggccaccggcaaggaataggatggaggatgaggaaggagaggagaagaggatggggaggaagaagatgaaaaaggtaaaaatggatgaagatgaaagagaccgccataaagagggatggtttataagtggcttgaagaaaaaaaatgaggagataaagtgcatgggaagaaaggagaggagaaaaagaaggaagagaatggatggagaaagtgaagaaaaaagaggaggagaatgagtgaagaaagaggaggagaagaaaggaggaggggggaaagaagaggaaagagaaaaggagaaatgagtgagaaaaaagaggaggaagaaagaaaaaagagaaagagatacgccggtcatagaggaggaaattaattcaagaaaaaaaggaggaagaaaatatgtatttttatcattttaaaaaattttattaataaaaatagatgatttgctcatatatttttaaaatatagaaaatataagtgaaattaaaataaaattaagaaaatatttttataattttttaaaaaatttcttatatcatgcagcggtgatgattcaatggttttgatccagtagattaagatgcagcaagatatatgtcttgcttgttgatcaatcatacaccatcgcgagaaaagcggatgatccatgattgacagagcggacctctttattttgtctcgtacgtgtccatcttctcctggcgcacccagtggaccctctccatgatttaaagctataaagaggacaataatatcaaactcaatagtagtatacattatttatctaagtacttgttctgccgccctcgctccgatgcgcttcgagctcttttctttatccgatccgccatatcggatcccatgtgatccgacgcagcttttgtcggtgtaccgcaacacgctcccctcgtacgcgccagaaccgatcatgatctcatcctgaccgtccgttgggtcatttccgtcgcctcggagcctcgcgtttcgtgctccatggtcgggccccctcacaataattgagagccgcgtgcgtttgatccagcggattgcatcgtatggttgtctcgttgtacggtctagatatcatcaccattttctttttatccacccctcggtgcttctggtacattggtaggcgttggctctgttttaataaataataatacaaggctgcaagctcattcaattcactcacctaggtttgtacaaggtttgagatgaagggtccccataactgtttctggtccgtatggtaagccactatttggagtttggacttttattacttgatctctctctactctctctctctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttttatgtttttatatttataatattaattaactaaaaattatacatatagagtagtatatcttcatgcattgattgcagctcttatttggagcatgaaagatgtgttatgttgggatgccaaacaaatagagagactatatagaaattttctattttagaaatgggcaatatggagacaaactgaatatgcacaacttcatagggtgcaggatctagaatcaaatattattatatcatggtgatataatgatttatttttggttgaccatatggtcgaacaagtgacccttggcttagtaattttttgggtttgatgtatggtccagattttaaaacattgacacaaatcatcatcagagaaattaatcgaaaggaaaaagccacaaagttatgtgttgcctagattaatcccccatgcctctgccctatgcttaatggggcatgtgccacatgcatggttaggccatgcatcgatgtgccatgtgatacaccaatgacgcccaataggacttgacgtgtgtcacacactaacctgcacatgcatgagcacaaaggatccgcactcgtatggtgttttcctcttggtaccatcctcaagaacatcacctctctttgaggccttctaagggtaggatgcttttaaacattgccatgaatagatactattatgtattaggatatacttatggaacttttcatgttggtaatgtcattcaattgcaaagaaatttgcatcaacatggtctatatatatatatatatatataaagcaaatttcatattcaagtgtgataataaaaatgctaaagttatatgcatgtttaggtgaaaagcatctatgatcaattcgaaaattgggatgcaagatgacaactatactgaattagaaagtggtgccaatcaacaaggagaattattgattagaatagttatatcatgtgttccttgcaccatccaataataagtcagcacaccatctaagaaaatggatattttaccatttaaagtagtaaaaattgtcagctggccaatcatagttaacaattaaactttttttatttaaaattgttaatcaagattggataatggtgcacctttttccaataatagatgatgtgcttgtttattattggatggtgtagaatccacatgatagaactgttctaaccaataatttctcatcaactagggcatgttgagataaagtacagggtcattaaaagtaattgaggaatgctatgggacctaaccctagtacaaagcaaagttcttttactactagcatgccaaggtgattggtgccatatttttagtattggtacaatgcctagggaggtcgttatgataaaaatattggagggattgcaaaaaaaaaattcaaaatttttctaaaatttccttcacacattttaatcttatcttttaattaatttatcatttaaagatttatgatgccattaattttttcattattattttttttaatttctgaccactaggctcctaattactaagtggtcatatgtatttaatcttatttttattttctgacagttgggctttttattaaagtcttaatgggtcaacaaaagttcaaacgatcataaatgattatattggatggttatagaagggtcacctgatttttctcatctaatcctcttcctctctttcttctagcatcttttgttctaatcttttttttaataattatttttttagatactaaaaggatctccatcaacctttttcatggttgtgctcacagatggaggatcttgattgtatcttaaagtagttttttcaatttgttctacacgagagatggaaatacgccttaagacagtatccaacatattttcaaattggattaattttatattttgatgttctgtaagtcatttataatttttctatcatattattttatttagttctaaattatgtcaaaaaattttaaagttctcttccaacaaaaaaagcgccaatcctcttaatacatagctctccaactattttccagagtgacctgttcatcctcctccattccatgaagcagcataattgaatcctatggatgatcaagtgattacaaagaatacaagagaattgctcagggcttcgatacattacaaaaattcacactattagtgacggcaactagccgtcgctaatagtccacatacagtcgctaataatctcaccgtcgctaattccgtcgtaacagtcaatttgaaaaattctgattgccaatatctttattagtgatgaaaatcctacctgtcactaataaggctattagcaacagctttagcgacgaaagaatttcatcactaattattttttaatttttaaattagatttttaaaaaattttaaaaaaatattagagatggtaaataccgtcgctaatgttgtctctaatttttttaaaaaaatttaaattaaataaattttttaaaaaaattttaaaagtaagtattagcgataatattttccatcgctaataccattgataataattaattttatttttttaaaaaaataattattatttttaaaatctattttaattaatcataataaattataatttttaatatttattacaattaaaatctaaagataatatgataatcaaaaattaaaaactaattatattatatataaattatataatttttttacaagcaatattaaaaaatacaatacaacaaaaaaatcagatccgatcctcatcatcatatgcctcctcctcctgctcctctccagcaattggtggatgagagtcagatgtcccagcatcctgtaatgaaaaaaataaaataatattagtaagtttcaatacagaggcatatctttcggtatacttcttcgatttttgaatagattattcttacatattttatttgatgatacggagctataaatacctccaacccatcgattggatggttagattgaatttttattttctaaatctacttttcggactcaaacctaaatatatgaagcttctaaatataaaaacttaaaaaaagtaaaaaaatttagtaatataattatctaatgtgatggatgggatgatgagcccaatcgatcgcacaactataaatcctagagaagctccatgatcgtatcgcagatggcatccaggaggctctgaagtcgctgactcagaattactaaagtattagagtttaccacatgacatgtgtaccgtagaactatgtgagctggctacataagagctctcttttccagtgctccctcctcgactatgacagctccgaccttagaaagatatgatctataatctctaaaaataaatataactatatatcaaattgtaataactatgcactaggataaaataactatatatcatatttatttaactgtatatcatgataccttaactttataccacattcataaaagtaacgtgcataatttatgactaaaaaaaaatgagtaatattagtctgaaacataaatcagaaaaaagatatctaactgcatcaatgggatacttttgtccaggtcttgatgatgtacgattcagttccctttcgagtatcctagtttctgtaagaagtagttattcttcgatgcaaggcaacttgtcgcaagtatttgtcacccgatggagtttgacttctatctttgtagccatgcaaaccaacatattatcatgtactgctggatgagaatcatttttttgctgatatattgtatatgctaattaacaattttatataacatctaatcattctgatgaaggatcaatatcgattggtgggtctaaaaataggtctgctatggtacatcatctgccgcaaatcaagaacaatattactagaggcatcaagttgatctagtaaaataaatagatatttaagtaagtggaacctcggtctttgactttctagacttgtagaattccaagaaaattattatttacagagggtatttaaggaaaagcaagttccaatctataatgtaccagtaagttgttgctccagggctaatgacctcccaaaaagagaaaaaaatatgtaagacttcgaatatacagaaaaagagatcagttctcattgcattaaattttctgttgttctaaaaaatggcaaacaaaatctattggtatccatcaggttttagacatcatatgggaacaagaaaaagagcccatagtaatttatagaatcattcccttcaatatccattaattaagtttgaatcattatcagaaaaaataagaagacaaccaaaagaatatagcaagtaaaatccatcaacacccatcaattttaagacatcatataggtagaaggaaaagaggtcagtcctttcaatatccatttagtttagattatcatcagaaaaaataagaagggcaaccataagaatatagcaaccaaaatccatcggcacccatcagctttaaaacattatatagaaagaagaacaagaggccagtctcttcaatatctatttagtttggatcattatcaaaaaaaattaagaaggtaaccataagaatatagcaaccaaaatccatcgacatccgtcagttttaagacatcatatgagaagaagtaaaagaggccataatataatctcaagtctcatgcatctaattgatgcggcccctatcgtcgctaatactcacaatagtaggtgcactggtgcagagacggggccgcagggtcgaggccacgggcttggagcggtggggcaggagccatgcggtcaggtcggcggggatggaaccacaggaagcctaatgggataggggccgcaaggtccgatcggcgggatcaaagtggccgcagtcgaggcaaggtcggggtggctggctcaaggctgcaacataggaggcaccggcagggtcggggtgatcgcgggcgaggcgaggccggggtggtggactcggggccatggtgtaggaggtgccggcggggttggggtggccgcagacgaggtgaggctggggcggctggcttggggtcacggcgtaggaggcaccaatggtgtcagggcgatcgtgggcgaggcggagctgggacgactggctcgggaccgtagtgttggaggcactggtgaggtccgggccgaagccactggctcgagacggtagtgtaggaggtaccgatgggatcgggactgttgcaagtgaggtagggctgaggcagcgggctcgaggccgtgacgtaggaggcgtcagtggggtcgggacgccaagaaggaggatgtacggggagcgaggaatgctgggaaggatgcactggggagggaagtggccgccagtcaagaggagacgtcggcaagatggaaaaaagtcgggaaggaggagaacgagaggggattcgtgggaaggagatgagtgcagaatttttttttcttccaatagtctgagggtgttttttagacggactattatcgacggcaatagtcgtcggtaatacagtcggtaaaactccattttacatgctaggatattagcgacggcagttttcgttgctaataccaatccactatcgctaatgctattaattttttaaaaatattaaaatttaatattaaatttttttcaaaatttttaaaataatatttttttcaaaattattagcgacagtaaattattctgtcgctaatgctattaattttttaatattaaagtttaatattaaattttttcctcagttgttttttgaatggttaaaaattattattaaattttattaaatttttgagcttaattaatttatgaaataagttttaattgatttagattagatttaatttaattaggcttgacttaatttgaggttaattgaattttaatatttcaagtaggacttagatttaaagtctgattgaattaggtttgacaggatttcgaattggatttgaattgaatcatggatcaagtcctaattgatttaacttagatttaatttaattaggtttgacttaatttgaggctaattgaattttataattcaagtaagatttgaatttaaagcctaattgaatgaggtttgacaagatttcgaattggatttgaatcagattcgaattggattcgaattgaatcatgaatcaaatcctaattgatttaaatcagatttaatttaattaagtttgacttaatttgagactaattgaattttataatttaagtaggacttggattcaatatcaaattgaattaggtttgacaagatttcgaatcgaatttgaattgaatcatagatcaagttttaattgacttaaattatatttaattaaattagatttgacttaatttgaggttaattagattttataattcaagtaagacttagattcaaagcttaattaaattagatttgacatgattttgaattggattcgaatcggacttgaattagattcaaattgaatcatggatcaagtcctaattaacttaaatcagatttaatttaattaaatttgacttaatttgaggctaattagattttataatctaagtaagacttggattcaaagtttaattgaattaggtttaacagaattttaaattggattcgaattaaatcatggatcaagttttaattgatttaaattagatttaatttaagtaggtatgacttaatttgaggttaattgaattttataatctaagtagaatttagattcaaagcctaattgaattaggtttgacagaatttcaaattaggttcgaatcagatttgaattaaatttaaattaaaaattatttttttaaataatttaaatcagattaaatttgtttagacttaatttaatttgaagataattgaattttacaatctaattaggacttaaatttaaagtctaattgaattaggtttgataggatttcgaattggattcaaattgaacccatattgaaaattattatttttttaattaatttaaatcagattaaatttaattatatttgacttaatttgaagataattgagttttataattcaagtagggcttagattcgaagtctaattgaattagaattgacagaattttgaattgaattagaatcgagttcgaattggattcgaattgaacacaaattgaaattcattttctcctaattgattcaaatcagatttaatttaattaatcttgacttaatttgaagctaattgaattttataatctaagtaggacttagattcaaagcttaattaaattagatttgataggatttcgaattgaatttaaattaaatccaaataattttttaaattattagtgacagaaaagtatcaccattactaattccatcgctaataacattttcaaaaaaaaaaaattagattattatttaaatttttaaaaaaaattattagcgacggcaagattttcgtcgttaataatctcaattcaccgtcgctaataattattttatgtttcaacattccaaaaaaatttgaaaaatttaaacacttttagtaatgacttttgtcatcgctaataattaaactgccgtcgcatatagtattagtgacggtaatatttttgatcgattttgtgatggctaaaagatattattagtaacaaaatttttttccatcattaataccatcgtagatattcaatattcttgtagtgatagtttgagatacaacatgcctatcatgaagcaacaccgtcggtcgatggtgcactgatagcactgaccacatttgagcacatccttcatcttctgattttgaggtgattcaagctttggatgattttttttttttttgataagaatagcttttggtgattctgtcatgtaaagttatatatctgttttgttctgggtttgtttttgtttccttttgaacgtttgtttttgtttcctttgtgagatgtgagagctcgttcctaccccagagagagagagagagagacctcgctagaacatctaatcggactgataaaatctttctaccatccaaattaacaaggcctaaatgtcattgtgcatctcgagattcttgtgaacatccttcatcatacttctcgagatttatgcgcatagatacgtgatatctacgttatttggtgccccaatactagctatatgtatcgtgctatgtaaacaagtacatacgtacaaataatatatttttttttcttcacatcatgcccaatattgcagtactaaagtttacgtgatttatccattgtttaatactgaagtaattttgtcaaagttatgaactgaacaaagaattaaatattatatgcagagagatgaaagtaattattaagtcttcatgcatttgcactgatggagatttctagtcggccgaggacagccactgcattatgtctcaaatcctttagatatgcatgattccattgcaggacatgagattaattgtttcccgtgaattggatagagcggataaccctgcacaacggcagctggtctgccatggaagagacaaacagtagtgggtgaaggaaagtttaggagctagctaggaagttggaaactttgaactcatgggattccatggtccaggccactgatagctaattcaataatatcaaaggattcggattccatacacaaggatacaagtactaaggacactctccttcctcggtaacctactccctctttcagtctttctccctggttccagacatttatgattgggtgaatagaagccagagaaaaatggagtgaaactctatatcaaacaacggaaagaagtagctttaatttcccttctgcgatctctgttaattttttaaagtatcggaggtagaagaaggtggcgatagggacggaacatggtacgggtggggctccgattccaactccaaggggggaaggatgtctcaaatggtggacgaagacagacggagtcttttatctttcctctttgggttcgacacgtgtcgctcatgcactatattaaattttctgatgtgaccctgtccatgccacctttgggctttcatgttgtggatttaagtgcttgtttataaaataatgaataaataaataaaagtgtttgctctacgtggaggtatggggtagactaataatgtgggagactggaacgttgacctcggggaaaatgatagatatcctgccaacagctacaggccaaatagtttgacagcacttccaaagtttccaaagcaagcttgtaccgtaaggggttcaatggggtcggacgaagattgtataaaaaattttaccaatcttaatctagactcaaaaaaaactctgagttatatattacacagataaaaaattccaaaactttgttattaaatagataataccatctcatcatcttcataattcgttcactaaacaggttaaatcaaactaaacaagttacgtagctttggaatgggttaaatggatttaaaataagttaaatgaattatattaaattggattgagatgagttaaatagatttcaaattaattaaatcgctcgtaaatgagttaaatatgggttgtgaatcggttcaattattaaataatcacaaacaagttgaatggattgatcagagatctaaacttgaacttgatatagatcgcaaataagttgatttgtttgtaattaacttgaactaatgtattctgagttaaacttgattaaaatatctcagctatggcactggtcgtaacttaccacctctaattattttatacttaatcttattttttaaccgattattgttctgtaggaaccataaagaagttacttgcgcgctacatgagacctttagaaatgttaaaatattaatattctatctcaacctaaccaacacgatatcatgttaggtcattaagaatatatattaggatgttttcctttcacctgatatcaatttttggaatgatcaaattgtctgatttgattatcctagacaaggcaatagcatatttataattgatattaataatacaataagtatatattttactatagttggtaatactaaaattatcataatctataattcaaatatcagtagagtgtgataatttatacagtcctataatataaaatatctaaaataatatcatattattttattttctggtaatattattagtttaaaatatattaaagtcgtaacaattattggtgtggcgctattacatcatatttaagtttttattgtaatataaaatacattattattgaaatattgataaaaatatggtattatataatatgttgcattgtcgtataatagtaaaaaatatattttccttatatatacatatagtaaaagcttctttttattattactcaaccatatataccactaacaagaaaaatgatatccaaactcgtcagatgtcgttttatatatcccattttatgagaatcctgctcacggtggaataagcattctcatgccaaaatgagccaaataaacataataatgggttagaaagggcatctatatccatttctgacatggaaatcggtgaaggtggtaacaaatatagtatgaatgttagccatagctctcttgaaaataacttcagatgtaacgattcaacctttgttggtcttgagttgtctatccttagctcatccttggttggataggataagatcagttgcaacatcgacaaagctcggtgcctctgacatcactttcattttttgtttgctatatatcttttaaaaataaaattttattatttgtaaaaaatgaaaatcagaaatttttatttttgatgtttataaaaataacaaactcattacttttaatattttaaaaataaaaaaatatattttttttactatcatgataataacaccatcttcaccgccttagatgcttttgctattgtctatcaatatttttgtccagctatcttagccacatcattgctatcctttttttttttttctttatgagtgaaagggaagcagaagacctgccatctgattattattgattgaatatatacaaaaacaagaagaagttcaaaatagactatagtaaaaaaaaagctaaacaaacaaaaattggacagacaaacagtccaaattgagtttcaaaaaaatgaacgagggtaagattgtcacaccatcactatcattgttgctacatttattgcaatgctagcatcccctcaccaccatcatcatcctcattgctatattgctaccaccatcaccatcatcttcattacattttgaccacccctactatggccatctctatcattactgcatttactacactgccaccatcaatgttgtctttgctaagttgccaatcccttcgctatcatgctacatcctccaaaagacactatttttgccaacaacccctacatcatgtccatcgtatctaccatttatatcatcgtctctaccgctatcactatatttatattttaaaattaattaattatatcaaatatatttatattttaaaaattaaaagtatatattttatttttaaaatttgataaatgaaagtgatgtcaaatgaagtatacatcaggtcccaatgacctaaaccatttggtccgtggttcgccatcatgtaacaaggccccaactctagtcatagtccgtggctaccatatttggcaatccaaattaacgtagcttttttatgtaaagcctgttaacataatcggctggcccaatttgcccacttgctagcgaggggggcaatttctgacatggcaatctcgccatcttgttccaatttgcccaacaaagaaaggaattggcaacttgggttggatttggttttccaattgggtgagttattttatttataaatcggtaagatatgtatgtatacattcgaaatggttgtgggtttagaacttgccatgcataattcatggtcaagccaaaatgggggaaataaaggaaaaaattaaggaaaaggcgaagtgagtggcttgttcagaatctgtcatgttttcttctatacttcaatgacacattgtcttcccactcctttctttcagtttccccggacaactataccttcaatccccttttcctggcccttcttcatctttactttaagatgtgaatgttaactaattgtgtacatatctccatataaaataaacgagctgggtatggtatcattctttgcaactcaattataaatagcttaggtatgaattaaagtttttgtttgactagagctctctcttttttcttttcaaaaaaaataaaaaaggaaaattgtaatctcaggccgggcctatcttatggagcccgggtcggaatgaagcccaaggacctcatatttatgtctagatttccacccaaccgtgaaactaggccacgctagtttggggcctggggaatctgaaatttttagacctcaaaatcgtgcctcagtccagatgaatggttttacttcttttttcttcttctttggtaaactttaatttcttcttgttttttgaagatgtagctgacaggaatagtggcatgacattgtagctaacacttttctcaaaaacgggaaaataagaaaagaaaggaaaaggaaattaaaggctacatgaaaggagatggtagagcttgccattgaatccaacaccagacaactcttttataaaataaataagaattacgaccaatgttttggataggaaatggagatcgatggtgatgacaaaattatgaatcaaactcttttataaaataaataagaattacgaccaaatgtttttgataggaaatggagatcgatggtgatgacaaaattatgaatcaatccattcgatgcacacaaaaaaattatgcacagaataaatcattgtctaatctcaaaattaagaagactaatgctaaaaggtcatttatcattttagtttatttccaatcttgaagtttatctgatgcataacttttgccaggagtcctaacagagcaatatatcacttcgagttggcctttgggtagcatagaagacatcccatcttgaaattttttaacaataacaataatatttgttgggtggatgtctgaccaaaacaccacctctcaagatctttccagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactgctcgaactatcttagacatatctttaaaaattaatttgaaataaatgctaacttaaaatttatttggcaggtcatatgtttaatccaaataggtttaggtttttctataactaaggaatcgctatacatataaactctggagaacttgagactccttttatccataaaatcacaaaaatgctaaaaatctgacaagttttctcccgcattccttttacttatggagtttcctaaaagtgtagcaatattagacttatttttttaattgaagttaagcatgacttaaatcagtaaaaaagttattattgaataaattaaaaattaaaaaataataatcactttttctttcaccaatcatcagagagattttttttttggtacaaacgaacggtcataccaatctagtgtaagaacatttcaaagagtcaaaatacaaaatatcttctaaagtccgagggcagacgtcatcttgacatcaagtccagtctccagtatgctctgcaacaaagaaagcaatcaagtccgcagtactattagctttccagtaaacatgctgaacatcatctcgatggagtgatgaagggaccttcagatatcgtagagaagtggatgaacatccagatacttcatctcatcctaaattcagtcaatgactggagtggagtcaccctcaatgaagatcttttcagcccacaactcctgtctcgtatagatgatgcctgccaaagcggcacgatcgaagctcaacactggggatggtcggctcaaagagctgtgagccccccatcaccaaaagtctagtattcgggctccggatgacatagcccaaaccatcattgcgatctctgacactgccatcaaagttgacattgacagattcggaggaaggtggctctcaggaaatgaaagaacccttcgagtcattgtaggtgcagcaagagaatcctaaaaacttgaggcagcaaggctcggaccagcagtgtcgaagtgacagcactatatagctaagcaacaggctctttacagtacccattgaatcgatataatctcagtatcaaacaaaaggctattgttggacagccaaacctgataagtgacatacaccatcctactacccccgggcgaacccttgccatgctccgatggatcatgtctaagaagggaggaagctaagggccactgattccctccacggctagccccttactatcctccaaatcaaagtcaccctcggatagcaaaggagagcatgctccgttgactcctcctccagcccgcaaactaggtagataattagaacctccatacctctatctttgagaaatatccgagtcgggagttggtcctaagcaaccttctagagaaaaagcctaaacctgggatgggcaaccattctctaaatccaagctatgttgatcctactatctggcactggtctgcttatatcgatgaggtccctggcaggagctatagagtagcaagactgcccccataccctcaagtcctagctccaatagacaagaattgggatggcaaaaatcatgtcagtttgttgctcgccaaataggtgggtaacctcctgagccctccaactcctgtcgtcaatagtgatcgaattataaacccacagatggttgtccacctctgcgctgacgtaggttggccaatgagagagaggcaaactagagatcccagcatcctggctcacatcaatcgagattctgtctccaatcagctacttgatctgagctaccactgtaggggtgcatgcacatatctttttccatatgaatgagtagctataatcaatatggatgtggggctccagactctaagctccataacaaactaccatcatcctgcttcacaaacaatcagactgaaagagaaatctagctagctgtatgtctgaaaatcatagcctctctcctgactagcaaggattggattctaagaccctcatcccgcaccggctgacagaccacatcccaagaaagcaagtgaagcctatagccccatgtccaatttcccacaaaaaattttgaaactgctacttcagacccctaagagaagaatatggcatcatagtattcaccaagaaatagatcagaatagaacttagaaccaatcttacaaggatattcttgcccatcatgaagagagcgttggcttgccagccatcgaagcgatctcagacttgctgctctatatgcctgtagtcggtccttcgaagtctccttctgtgatagggacccccaaataggtcaagatctctatctgctcagagattctcaatctgtcctgaattgcctacttcacctggaccctcatcttagggctaaagaccacagtggacttctgtagattcacatgctggttagaaagcttgatattaggcctcaacaatagttgcaaagcaccttgcatttcgaactgaaatctgactaatgagcaagcagtcatctgtaaaaggaaagtgtaagagtggctgactcccaagattaggccagtagggctctagctctgtcctttggaccgttgccccaagagtacgggagagagcattagtatatataataaaaagatagggggagagagggcacccttggcgaaaactgcccattgaatgaaaaaagtccatgggggcgccattgattaggatggcaaagcttgggatcttcacacaatccatgacctggccgatccatttatcttagaagccaaactcatggagtgtttgatgtaggaactgccagcttatccaacataggtccgctccatatccagcttgatcgtcattaagctctgacgaatgggtgcatgtcgcatatcatgcataaacttctggatgagcaagtattgataaaaaatacagcccaagagagagggtgaattgggttttcaaaaatttttactaacttaaaaaaatatattctctatttgaatgagctaattatgtatgcagtagaagtaatgaacgtatgaatgaaaatttaaaccaataaagtaagaaactaggaagcaaaatcataaagtcataaacattcaagtttatagtggttcaatgttaagctcgatacctacatccactctccaagtaatccttttgagaattattactataattacttgattatagtaagattatttttcagatttacaatcttaacccaattgattttgtgggcttactaactaaaatctatccccaagccactcttagatttgtacaaattcaattttaggctaggatgagccttttcctcaagtttcaatctcaattgaaacttgtaatatagaaatttgaatataaaaatatttaacaaaaacttaagcctcttaatgagctgatgatatgtcgttgatgcattagttgaggagttgggaggattttgcaatgaatgctctcttcttcctcttgagaaatacttgattacataagaaggctggtggttgcagttgaaaacctctttttggtagctcacttaagcctcaacaaaatttttaaagtatattgtggttttctcttatgttctcttgattttcttaagtttttttactttaataatggctcagacacatattaaatcaagttaggattactaagaatgggtttgtaacctttaaaacttgaaaaaaaattgtttggagatttctgtgcaaaattgcagctttctgaagactagccattggagttgtcaagaactatggagtcgacttgagcagatttggagttgactcaagatcttcgagagtcgatttgagcactatatccagaaaactacctctctatcttttctaagagagtcgacttgagatgtgctggagtcgactcgagtctgtatcagtgccatcctacataccggagtcgactcgaagtctgcttgagtcgaccctaaacctgtgccaaatattgaatttgtactaaagttgactccaatccttttattcttaaaaaatataaggcttggcctcttaactcttccttctttgattcttcaaaatcgaaatcttgaatatctttgaaataagattttagctttttgaaatttcttctcaaatacttaagaactttactaatatcaattttacactcaaatgttttgctattcattaaaatcaaacctaagatcgacagtaagatattaacaatgatgcaatggctactaacaaaatcaccctgctcccgactgatcatgtaaggaacaaccaactttcgatgcccgatcaaaattctcgcacacactttatagatagtggtacaaaagttgatcggtcggaagtaatgtggggttgatgcatcatctctcttcgaaatgagtatgatcatcatcttcttccactcctttaggatgcctctagattcaaagactatctgcaccgcctcaaccatttcaccatcgataatagcctagtaccatcgaaaaaaaagaagggggaagccattaggccccagagccttatcctcctcaaaagaccagagggcctctcgtacctcctcagtagacacagggcgagttagaatctcattcccctcctcaaaaatgtggcaaacaagctaggacccctggaagggggcatcttcgctcaagagggcagtccaacgtgatttaaagaaatacataatctatctcctaatctcataataccctccaccattctaccaatgctctccctcagctgtctgacgaaattggtagactttcgaattatcgtcaactgagaaaagaatctgatgttccaatcgtcctccttgatccactgtaccctagacttctatcttcatattgtctcctgttgtctcaacagagtagcttatgtcaaagctcccttgggtcaagctcttgaaggccccctccttatcttctctcctttggagcttcgtaatgttcgtctttacccccttgatctacttgaagatatcaccaaccttcagtcggttccatcagatatgcctgcgccgcgcaaactcgagccttctgattatatctcgcattaccacggatcaacatccttcaaacatccctaatcagatctaggatttcggatagaaggtccaaaacttatcggatagaaagtccaaaacttttcaaacctgaaccgagctctaggcaagcatgggccctcagtggtgatgagaagtgggcaacggttcgaagcaatgctcggaaggtgctgcacctggtgttagaaatcaggcaacaatggccaacgctcgatcaatcctctcccaaattctagctgtcccaagccagttgttgcaccaattgtaaatctggatctagtgtagccaaggtcaatcaggcccaagtctccattgaaatccctgaactctctagaattaatactatccacatactgcttgccacccatcttctcatgggactccactatatagttgaaatccctagcgataagagaaagtaggccctgcgccaccattctgaaaattttgggctatagcaccctccgctccctgtacttggtgctcgcatatcctccggacagaagccaaagaccatcagtttgctcagatatgactaacgccacctgttgctcatatctgtagaaggcatcttccttgatcgagttacgatgccaccgcaccatgatcctcccaaacagactcttggactctacagcgtaggagctccacactaacggaatccattttttggctcgcctgcatcaaagtcattgggccttgcctgtttgagctggcctaagcccaaccagcttgcccacccacaaccccttcgtccatctgtggcccatctggtccatgcaccacgaaggccctaacgcttgtgaacgggctgatagctgcatcccaacccagcgctggcaggccaaacttgttgacgggtcggatcgcatacgtgccttcgcctacatagatctccatgcctatacaaccctccgtagccccttccttcgatttggctgttgattcgggtctgaatccgagcggcgattcccgtcatgtgatcttggatggcttcgtccagccatcaaatccggacagcatgtcaactaagatcgaatcatctcgaatccattattttttgaatcgattcgacttgagatacgactaggtgcctcgttgactcggccccttcttccccaaagcgcccaagatattttttttttttgtttttaaacttgttttgcgaaaatgaaatttcgtcggttagacatccgcctctcgcaagttattccgtcccgcaattcgcccagacatcccgtatgtcgttgacgccgttgcagactccgggaggtgtctccaacatcccgtcttgagctctaatccctgctgctctcttcgcttcgaacctttacaccctccccgccacccccccccaaaaaaaaacacactcgacgtctccctgaagccctgacccagtcctctcgagagccatctccaatggcgaacgaggagcagaagaaagaaggcagggaagaagaggagcaggtggtgaacccgtgggaggtcaccgccaaggacggcggcaagatcgactacgacaaactgatcgagaaattcggctgccagcggctcgaacgctccctcgtcgaccgcgtcgagcgcctcactggccgccccgcccacgtcttcctccgccgcggcgtcttcttcgcccacagatccctctcccgtcaaaaagatgtcatctttttgctttctctttacgtttgggtcgtggcattgagtgatatgcgcctggattgctgtctgttagggatttcaatgagatacttgatgtgtacgagagggtggagaagttttatctgtatacggggagggggccgtcgtcggaggctttgcatctcggtcatctagttcccttcatgttcacgaagtaagctttcatctcacttggctctctggttgttcttgaattcgtcaatagtttgtatatgagttaaattctgctatactttcatcatgttctgattttgatttttttgtggttggttggtgtcgaattacaatctttagatgtgtcagtataaaatttcctgattgcaagttggagttaaacttgctcgcaattcacagtcttgaaaatcatgtattttacaccaagcctttgttccatattggtttgataactatattattaaatgataaaatagtgtcaagaaataacagtttatcatgtggatcatgccaaaaattttgttggtactatctttctcttcattcagtcaaattctattttcattactctaggggtgcattccatttgagtctcaaaggtacaagtttcttcatttgtttgatcctggtttgtttcctttcttattctgtgaactctaaacccaatcaagagaattttctgtacaccttgaccataaatgttgtttgggacttttttgatggtagtcattttcttgttgcgtggacataaatttatggttccctcctgggttcttgggcttgcatgtgatttgggctacttggacattgtggaataattgggtacttgaatacttaacaacatggtttctctggacaatttatatcgaataccaaggcaaatgtatccttctaatgtctcaaatttcagcaaaagtgttaggattgacattacctttaggtttttctaattattaatctatctcacacttaatttaaatggcatgcacaattcaggcttttgtatatgtaaaatatcgatatttttaatttgttccatcagcccctttttatgtgcttatttttttaagcacctccacctgtatcacatgtctaggttacaatggccttaaatgcattctaacttgaagaattgaactggactcccattggtaagcaagaaaaaaagaaagaattagactacatgcgttgttttccttttgtcaacttgtggttaggaaatttcaactttcttgccatatgccttcttgatgctctcgagtaaaacctagtttttttcgtcctttgaccttgatcaacatgtaagcttggtagagtcattaatttttctcctggataatctgatctgatgggtgataagccagcgactctttccggtctgcaagcacgattggttgggttaagccacttttctatgggctatttgttcacttatgcagcaacctctaccttaggaaaaatctgttaatttttcattaccattgatgaaggcatttttgctgggatgtctgaaaaccagtcgtacaatgtttgcttaaaggttccatttaaagaacttcataaataatttacttcttttttttttttgtagtatggcagctctccctaaaatgagggctgtgaagttacatacatatgctttgtttgattaaggatcttattgtgtaagaggtcaagtgttaggtcacttcaatctttataaggtttcaaaaattgaatcctagaactccatcatggacaacaaaagcaccccttgtgaacagacttgataattgcttctttttcttctctgagaaaggtttagtaaaccaaaagcacctcattgtctgcgtgcttaagtgaattatgtgatgtgaggtattgtggattgtcaataaatgctcgtagaaacaaaaatgagcaattaccttttccggtttctttgtatctgcaagtaacattctctcaacattcaacaaatatatgatccttgtaatccttctcgattgaagcatgaaaaaagattgaatttgagttggcttcactagcatcttatagctttctgattcattacatgtttttttattggttttacttggatttgtttcttttactttctttctctatcaatatggtgctaatttctatgtaggataaagttgcacttacattaaagccacagaaccaagactgagcttattattggattttctcattctatctcttgaattggacctaagcttcattagaagcccattcctgtggtggtatatgttggctgcactgaatttttaggcatgatgataaaccaaaattttcaagccttgcacttatcatcctagatcaatttaataaatctattttcaccaatcattcctttaatgggcttcctccattgtcacttctagttctttcaaatacttattgacattggcttaatttgtgtatagagaatttgttgaaaaacatttctgacattaaattagacttattgaaaaagataatatgcatatttctataatacatcatctgcagtcctagcttggatcgtgccccggtccagccaatttacttaatcatgcttggcttgtgcggaacttgtcctagaaaaattttgtcggtgaaaccttttgttttttttctgactctgcatagtgtgcatggtgtgcatttcaccagcttgacattatcttctgtaagttctctagatttatatattttctaggaaaagctaagtcagtaatgtagtaataggttgttccttatgatttttgcagatatttgcaggatgcttttaaggttcctcttgtaatacagctaactgatgatgagaagtgcatgtggaagaatctctcagtagaagagagtaaaatgcttgctcatgagaatgcgaaagacataattgcatgtggctttgacataacaagaactttcattttctcagattttaattatgttggtgggtaagttatagttgagtgttgtcctttcacttgcatgaatagatatgccaatatctagtggcataacaagaacaatgttgttattgaggtcatgtttgacaggttttgtgctgcacctgtttgattctgtttcatgttttttcttagtttattagatttcactctggagcattaatatgcatagatactttgcttgtatacataaaagctcagcaatcattatgctgaatattctaattggttgacctcaaggtcacttaaattccatttgcatagtggatgttgtttagttattcctaccattggagattgacatttttgctatatttatttatatacaaaaagacaggttgtaaattctcaaaaatatgattggtaaatgctggtgatgggcattgaactcgataggttgccatactctttatgttatcatcatcatcatcattgctaatattatttttttggttttcaacttcgccagcgtggtaacacacgtatgaagtttagagatgatgttgagctcatcaggtagacataatgaaccaccgatttttaagacagaataaaatgaatgaggaattgctggctgcggaagagtcgcatcacaactatgcatattcatccataaaactttcatgtgacactgaatttaactctcattcaatggattaatctcctgatgcttcggatttttgttgcagtgccttttatgaaaacatggtcaaggttgcaaagtgcatcacgtttaataaggtaaatgctagagtcatttgagataaattccaattttatgtgggataagtttttcttgttatagtactgttttcttatgtcttgcatttgtgtaacttaggttgtgggaatatttggcttcacacaagaagatcatattggaaaaattagcttcccgcctgtgcaggttcagttaaaaatactgttaaaaatgcttataaattttcagttattttagctttctagtctatatgtacaaggcttcgtgtgtgtgtccctgacttgtgcttttctctaacattatctgcattggcagtttagaaagaactgcttcatcttaatatcatacataaattctttatctgtaggaagtcccatcgttccctagttcatttccacatctcttccctggaaaggaccagcttcgttgcttgataccatgtgccattgaccaggtgccaatttcttaatatttaatactttgttttgatttaaacatgcatatgctctatagtaaagattgacatatccccactaattaggttattgttcacccggatatctattttggcacaagtttagtgactggttacctgaacacatggcacatggccaagatgtcttgaagattctgacttaaatatttaagaaccaagcttggtgcatccttttctatttatgtgttgtgtaagtatgtatagattatcaattgatgagtggttcagtttggtttctgttctataccttgcatgtgcaagcatgtgcagttgatcaacttatccatcttcttgttagtcaaatatgtcagaattctgtgacttctatatatagcttcattgtgtttattcaaatgatgatgtacaatttgatagtttggcttcctcacgtttcaatagtataaacaagacccttcatataatattaggtttggcaccattcactatgtggggaaataaggttataagatcaataactattagaagttccaaaaactgacatgaaaggtgatgctgtaattggttttacaacacatcttgtcaagcagtgccgtgtcatttcatccagtattaaaacattgaattgtcaggatacttcaaatttcctcattttcaaagtgtccacttgtcgctttgtagatcaaatttcctagttgaattttcttaagtggggtttaggaaggactggtgaacatactgataactgatctgctattatattaactgtgcatgaaaattttggcacaagtatccatgttatctgttgaaaagaggtggtgcttctggtaataagcccttcgcagggacatgatcaaaatctggaacttctttgcttgtccatttgtatgataagcaaccaggagttgtgaacaaacttagagaatgtgaagacaccagatttgaaattttgaatgacattttgacagtctagtttgtacaaaatgaagtcaccacatatgggtgtatcacctgtatctaatagttgatcattatagcttgacttcttgatccactttctgattgtttagtaaccaattgtgtagaaactctgaggatacgttgctgatgcatcttaattttgactacaattttgcttatcatactttacagcttgtggtcatcattaaacctcaacaagatgttccaatggcttttagaaaccagatgttttggtttagattaatattttaatggtctagttggtgggctttgatttagtggatggagaagtgatgcacctctgttcaacttaatatttgaggttttcatttggtcctgaagagcttaggtagcctttgtgggaactattagatgctccatccatcatatatgcataatttgccttgcatgctagtttgttggtgttccatggttccaccggtatgtgctttttaaaagcattctttgatagtcccagcattagccgaaccatcttgaaccggacaatttaaggcattgtgagccatactggtagcaaactgaaatggtttagacggataaatcaaaacaccagatgagagagagggaaagagaggaagagagagagagaagaggggagaggaagataggacgacgctgttggaggccagcggtggcccgtcgaggttggccggagggccacgttggcctctgcagcttgatgtcgcctgatagggcatttaaacaagagagaaagagagagagaggggaagcgacggtaccggagggatgtgcagctggcggagaggttgtcagagggcaccagatgactgccgtggtcatcggacggcgaaaaatatccggacggagccgtggctgtggaataggggcgaccgcccctattccctcatcgcatctttttttaaaatgccgatgaatggtgaagcaggtaatggatttgctggcttcaccataatcaggattttttagaaaaaccgatgaaatagggacgatcgcccttatttcatgtccgcggtaccataggcgtcgattgtgtcgtccgacggccacggtggtcagtcagagacccttaggcagcctctccggtggcttcccctcttcccttttctttctttcctccctctctgtctctctctctctcttcctccttggttcccttctcctctgtatcggttcacggcagtacgagccatccagtccgatacggctctgtaccggccataccgtcggctggccagcacaggtcccgattttgattccggttctgccttccttgtttgatactattgtgccaatggaggaattatgagttgtatgggaaggattgactttatgctatgcacaagatgagagcttctcacatttatttagagggagactcctttctagttgttagatggctttcagatccacctggtgctgatgccagaattcatctacttttacatgattgctggtggatgatgcgtgccttgctctttattgaggtatcatatatttacagggaagctaagagtgctgctgattggatgacgagctgtgtaaccagtcacactgggactacattatggggttcttcaacaagtcttccttctcaatcattgaatattttgttttccgatccctgcagatgtatgtatacttatattaattaatttatctgacttaccaaaaaaaagaattctttgatgcctttattgaaatcatcagtcatttgcacccttcttcaatcaaattcatcatctctgtaaattgattcttgcattgatgctgtttatgaaaatctctgctgattggtactagcttcgtgatctttctattgttgttttcttttgaacagcagaaagccatgttttattagcaaactcaacctctaaaattagaactgtgtaagaacacattttagagatcaaatacacaatgcaatttaattttctagtaattttacaattcacagtgggagcaaatgtagtttcagtattgttcctgctttgttcattatcacttcatgataggttctcatgttgctgctaccaccaagcaactgcagatgtctgacatacaaggcctgttcagttctgcttgaataatttctactttgttcactctgtgtctgagttagggtgatgaatattttgttggtgttagtgtggaatttgcctacgtgcacttttcttttcttttttttttgtatccgaggatagtcaagtgtgctattatagctgttttttgccagtctattttgtatatcatgtcttttgttgctgttaagcaattcttgtttaccttataatgttattcatgatacaaagctttctgttagtgactgcatgaaatttgatatcaaagactggaagctataactgtatacaaagtaaatttagacctttgtaaacagagatttgtagtctttagttacatttttaatagcaaatacatggaaacaaattttttattcatctcagatgtgcatataggttggcgacatgatgcgctattctctttctttgttgttttgtcacatgtcttggtatgactagttccagatcaatatttccctctctgctttctggttatttgatttgcttgtagttttacctgatctttaattattttcttgctccataattatgttttgcttgaaatgttccaaccttttcccttgtattctatgatattagcctcatttagctgtttctgactggtttccacaacccaaccatgtttcacctttcatttcaggatccttacttcagaatgacacgagatgttgctcccaggataggataccaaaaaccggctttaattgaatcatcattcttctctgctcttcaggtatttaagtgaaatgtgtttacaatagaagttgaacaatactgtaatatgataggtaaatagaaagggtaaattcatgatttgattttatctctatttgaagttgtatttttggttcaattttgaaaacgattaacacttgttatctgtcaaatgttatggatctattgtgtttgcaaatatgctagtcttgtacaactactctattgtaaacaaagagagttacagatgttgctagctgatgaggggaaaataacagtaagaataagaagaaagagagctcagaatctatcaccaaaatgaaacatatggcttgcaccaaataatcttttgtgaaatccatcagctataaaggacactggggccctgagcaagcatttaactgtataacaagttttcttctttattttgtagatcaagtagaattacattcatgacttaacaagtttaataaatacatacaatttctatttttttgggtcataaccctagtagactcggatggactgctaaaacaaagaagatagcagtcttgaaacaagtaggtcctatcatttcatcattctgtatttccacttttttgcattaatttaattgagccttgtgtcagcattataaagtagcattgttttaactttgaaccatgtacctctcttcgttagaacttcagttggtctaattctaagctctctctctctctctctctctctctgtgacaagcttcttcatatggcacatgcatggcacaggcaatcttcaaagtcttccagacatgtttactccttcaaattatgttccatgaattttgctgttggttaaagttcaccaaaattacaacttaaacaactagtgaaggcgaaatattatctcttcaaggtttaaattcttgtcatttcttatgatttcaaagcaagaagtgcctgttcgtgtcatatgcaacatttttcaaaattttcagtgtgcctacttgttaggaaaataaattcaggagctttattgatgcatgggtgacacatgaatctgggaagaaggaacatgctttatataatgcacagaaaggtcaaatttataaaatggggcatcaggggatcaatttgttggatccatgacaattgtgcaagatttaatgatttatgcttaacgtgatactaccacaagatatgtgcgttgatgtgccacatcccttatcaatgttccacatgcattacctgctcgactaggtaagcactatgccatgacaaatggtcagcagtactctgtgacactcagtgagatctgactttatcagctcatacggagtggattgcagaactagggaatgagatctatagtaaataaataattttctctacatgttcatctaaacacaagtaaaagaaaatgagtagctatataaacacatgaaaatcatagtgcttgtcgaatgagactatgctgtttgcaatccactctccatctatcaaccttcttgattttcttgtagacgactacttaaatttttcactttaccattttgagtatgttccatttaactgcatagtttcctatggatcagtcattcatgtctattcgtttcctgaacctgaatatgaacagggggagacaggaaggatgtcagcaagtgatccaaattctgcaatatatgtgacagattcctccaaagacataaaaaataaggtttgtcttctatgtagcatcccaatttttatatttctttatgtgtgttatgttccaatgtttattaaaaattaaggtgtaatttgctttggtaatcctgaatgttaactggacattttcctctagttgaagttttacttcccattggttccaagtctaggatcaatatctttttctttacttttgttttttgatcaagtgtgatatttcatgagaactcctatggttctggtatgctttttctgattgtcggtataaggtcagagtaggatactgtttagcgtatggagaatcctttatactggatgtttaaaagaatcctctacactggatatttgactagcaatggaaacagattgtattgcgctagtaaatttttgacttcctcagtgcttttggaaaattgatctaagagaaactgtagtcaatggagttttcagtacattccaggtttttcttctcacatttgagcaggttgattttttccaatgtataatttttttttttgcaaggctatgattttgctcatgagtttctctaaaatactttagtcaatggcggatgttcagttttagaacaaaagacaggtgccaacagtgacatgccaatgtaatcaagaattgagctgaatcagttcatctgtcactaacatatagtggttaccacagatcagctaagctttttcctgtcccacatcttacagaagaatactgtgtttatagaagaatactgtgtttttatggctgattttgaaaagctttgggtcatggccttaattacacacaatgcttcaactgctttgtcatttattttataatgtgttaaaatagaatttggctgtttatagagttctgaggtcctcactcctttttttcttgaaacacatatcttagttgtcctcattgagtctcctcatctcaatagaatttccatctcaatttctcctctgtcgacgtaataatgtattcattttaaactcttcttttgtttgtgttcttcacaacctattcaacaatttcttctttaccatttttctctttgctaggaaccttttcacattctaatttatagtattatttaacaacgatgcattccttgccttctaaagtccaggaggcatgtaatggggtcctctacttggctgcatatggctgagacctggaattccagcacatataataatatatatgatttcaaggcatttctggtggtttagacccataccagtatggatgttctgaaattagtttttgaatcatgaaattctttaccaaagaaataatctttctccccactccccgttcccaactgatcaattatgacctaccaaaatgacatctgtagcaggttttctagagattggtgaaggatgttctgccagaaggatgttggtattgacaataaattaacaaaatgccatgtttgcatcctgaagctaatgtgggagtctggatgggaaatatgtgtaaggaactaccaaaataatccattcaatatcaaaaaaataaatatataaaagatagaaatataatttagctaattgttttaccctgtgtgcccctgctgctctctctttttacgtattgggaagttgcatggtcaagactcaaattcatgtccaaatcttgattctttcatcagcttccatgcaacaccatggtaaccctgagaatctgaaagcaatccagtttttggatgagctacactgcaaggccgataaggaagagggaatttgaggttttaaaccattttttgggcatatatgtttcgcttattcgtattaatgttggtctttcattctgaagcaattataaccatttccatggttatgtttctttttccagtcttatacaagtgactggggttttgtttgttaaaatttgtgagaagttgagaacttttgtgaatttggattgtatttaaaattgttaaccaaaaaagttaggccattatttagattgagctggtatgtttatagacaggatagatgggcaggtttgcctggagcatctgacctgctcttggctgtcggtagaatgacaacttttgatgggtctggttgtgtccaggtcaacctttgtgaaagctgaactagcccagcctgaccctttgcaaaccttatgtgcatgtcttgaatgagcatgtatggtatctgcaaatcctaaccaaaaaggcattatttgtactgatactttttctttgtaggtgaatagatatgctttttctggtggccaagattctatagagaaccacaggaaatatggagccaacctagaggtatggtgtcttctctattttttttgttatgtgtgttaaccttgtaaatgtcataacccttgcaaatatatggcatgagagataattttagtagttcattttactatattgatacttagcagatttaagtgctgatgcagttttttcaaaatttttagtggaaagttccttaatattttaaacataaaatataattttatattcatctctctgattgaagtcgttgaccttttaatgtcctcctccttttgttaacttcctccactgtgggtaagttatacatgaataacctacttgtctatctaaaaagggtcttgaaaaaattgattttgctatagcggaatgtgatggagaagtatttcttgtcatcttccatttagactgaagagtcacgtgataccccttggtgcatgaaaatgatgactccctactttcttgaaagatggagaagcatcttctatcaccgatactaaaacaggtttatatattttagtttatatttattcataagaaaaaaatgaaaaacattcatgagaaccaatttacatttctattctacttttgatttttgtcaaatcttctcattgaacttgaattttcatgtgatgtttgtacatggactctttcacattcttgttttatctcttccttcttgccccagtgcaggtactttgttggcacctcccattctctaattcacattttgtttaaatttaagccagaatgagattcatgactaacaattctagatttttttttcccagatggtggatgctttcatggctgtcagacctctacccaatatgttcagctaaatagcttttgacatacagatttcaactcaattcctctcaaggattaaaatgatcaaacagcagactttttctgctttactgattatcactgaacgaattgttgtactacctccatctatatcacaaccaaagataaggaaatcatgtctatagaaatgggatttcgggaggataccgaatttatttgtcctgcataagttttggcaggaaatcttattggaaaattgttcttgtttgaaagagggcccagagtaatttaattttttctactctttcgattgacactcaaaatactttttggtgttacacaagtattcctgttctccagcttgtttgccattgtgctgaaacagttgtaagtttgaacagtggtaatctgcatggataaaacataaactgatagtcacttaaaaattggagtatttctcattatttggatgctgtaactgttggattgcatgaaccagattcctgtatgtgccatgtaagtggaaggaagcatggatggcattgatcctcttatctgatcagtttttttcttttacttatgtggcttggtgaatgctcttacatcttggtgtctgtaattcattattgtgccctgaaggaaataaatttggtgtaatatgaaatctggacacatgatgacatctgcaaccacgaccattcatatgtaagagattttttttttcttttttctttttttttttcatgtaacagtgcttcatagcaggactgatgggattgtgaatggctgtgattctcctgtaaatgaaaaatattttaaattgttttatcatacttgattaacatctaatttgatagagaggggagtcaatattgcaggtgagaaatgcgtagcatagaggagaggtaaagagtatccagatttctttcccctaaatatgattagagaaatataatttgaagatatctgttcgctgtacctgtttggtaactggtcgctgggtgtaagtgaatcccagttgcagttttccacacgcattctcagccattttcttacagggtatcagttgagacacttggattttgtccaaattacgatacttgccatccatctgtgggcttttcaccagctctaattggttgccttgaggaaaaattggatcattctttatacaatgaccggtaaagaaaaataaaaatttattatatataacattttaggaagcactgtagcaaatccctaaccccaaatatgttaaggagggagttgcaattaaccaaacactacctaaaagagcatgtaatgagaccaagaaccatgtatggaatttaatttttgctagcaaatattaaaaaataaaatatttgccagtgagtcccagaaattagaaaacacctagtccacttaaccttttgatctaaatgaaataaccatccttttctatttttcatatttattaaattaaaataatttattttctgaacactagctttactaaaaaataacaatgatagttttttcctcctcccttttttttttttgggccttcttttggatggaaacgacaaaaaggcccataggcaggcagtgagttgtgtgaggggagaggggggagagctaaaaattccaccgctccaagagcggaaaccgtgcacggcgatgggcggcgttcgaggggttctcttggacgaatcgctcctcttctccgatgccggaagcggtaatttctacctccctccgggatccgcaactcttcttcgtaggcttcagtactcgaagcttcgcgtggtatacgaccttccaaaatcctcttctttttgttgtttcatctcttgatttcttaagcccttgacttgtctggcaagaaatggccgtctttgaattctgtttttgggatcaaattttgtggcaatcggtccaaggagccatccttctggcagcttcaatgcatcgctattgattcctctttttctctctccatttttctcttttcagttttcgtagttaggtttctcattcttgatttgatctgtttgaagcaagagaaattgcgtgaatgtttgaatgtataagaaaaaaaagtttccgtgcttttgaattggtttctgaaaatgttgatgatgcttgtactgggaattttagaataggaaaacagtatatatatattcagttctctatgctgcatgttgggtttatctgtcatgtctattttgaattttaaggttgaataattttgtgtagaatgctgttcttttctcctattcctgtagtttctgtattggttttgaacactatcaaaatcattttagaaaacgaagacccaaattttttttgtcctccattctaatttaaacaagtttgtcaatcttccgttcaaagtgttaaagctttggaacaaggtgtctgctgtctatactgtatggtgtttatcaatgattaatttcactggcatgcggtatgatttccttgaatgctagtgtggatggttatccaaataaaagtttatcagttgagtgctgtggcatatcctatcatttgcttgtctgttactctttacctgaaaattggcatggcgtgatcctattcatgaaaagttctaacctctatgtcacacttacttcgcagggtttttgttaccaaaaggatctatcaccacaaaaggtgcatcttgttattctcttagctttattttatttttattttttaacgtatcattatatgattgtttatggaaaaaatgtgagcagttttcttgtttgtatatgtgaggcaattttagaaataattataagttgcacctgcatataagtgtgttattttctagtagattgggcatatctataattttacatgcaatgcaacgagctaatgcttacatcaaaattgactgctggcttgctttgcatctttgttggtcaattggaggattgggcaaatctttgttaattgtttatatgattcaaggtctagggagcagccatccaaaatttctctagatctgaaatgagtctagatagggaatatgaaaaggtttaatgcagaaagctatgtgcatctgattgttgaaaattaaaaatattataagaaatatagcataatacatgggtattggaatttgatctctccaacattaatttaaagtttcaaggcctttgtaatacctgatgctaatcttcagaaaaggggcacaagatgctatgcagtcataataagatttatttgtaattaaatggcatttttaggagtgtgattttcctgttagacttgaatgtattataagaaataaaataaagaaacatggttatgaagaacactgatgatccaatgaatgtcaacagtgaaacattctctcccttgtaatggtaaagttacagtctcttgcaatattcattttgtggaaagaaacaagataagcaatgaatcaagaaaggttctgagtggctgtgccagtcacccaatggcatactatgtgctatgctggcacatgtgccacaccatcccaagacaaaaatgtactgagatgttcttttagttaataaaaataaaaaaatggagttaaatggcattgcaccagcccattccttgtgccagtattggactagcatgatgagtcaagctatattattggcacttatcttgagcaaaagtatcatcggcacttgaaaccatgattctgggcatgttagatttttttattcttttgaaaagaaatcccggactcatattcaaatgaactaggatgcatccatgctctttgtaaaactgcttgatgattttctgttgtacgatatatcacaaaggtagccacacacaacatgatcaaacttatctgataaattcttttgcatcattccacaagggtatgatgagttaaccgttatagaagaactgttttgtttaaaggggtgatggtgttgttgtttctctttagagtatattggctttgtgtttggagtgttgctcaaaattgcgaccaaattgtattggtattggtcataaccaagaaactagggccaactttggagattcagctggaataactcatgaggccagacggtctacaattctaatttatgctcatttattttttaaatgttagacggcagtttctctattcaaattttacatactttgaaaagatatttgaattaatgcaataagctattcaaaataagtcctgcagtgctaaatattaaattcgtaaaatcattggcttgttgtatgctagaatgccatcaaatgccaaaccattgtcacactctgaactgtgattcttgactttttttagtttttaaacaattctgatagattcaaaaccacctatatgacaaatgcagaagtcccaaaacaacatacatactttatagatttattttatttttcgtcgctttttctcttaatttctttttttacatgttttacttagtaattttcaatggccattgttgagactaacttgaaaaccactgaaatcgaaactcattggtttgatggaaatggaaaatgtaattgaattgaaaagactttattggttatgaaaaaagaattaagacatattattttaacactttattgagatcttatgcttggtttatgcaatgaaagtcagtctttgttcgtacccttttctacatcaacaatttctttagtttgtaattcttatacttttgcataaaccaagaggttgttgtgttactaaagctaatgtactgaggatacgtggtgcttttttgtttgatgattattattattattattttaatgttaactctaaggtctggtgagtgatgtatcaatgcctatccattacatgacatgctggcaaggaaaaggatattttgtgcatagttgtcaagatgatgcagaaaattttggcttcaattacttgtttgggggcccagggttgtttagacacattaggtggtcatccagtcaaatagatataataaaacaagttaactctcatgactaggaatgcccgttgaattttgcatgttgtccttctagaactttcacctttttattttttcatagaagcctaaaaaggctttccaagttgacattatttttctgtggataccctttcgggaagtgcatattatcagtttcccaatataataaacgagaagaaaatgtcgccctaaaagctaaacccgtgcaaaatggtgcaaagtaattaaaaaacattttttaaatgcacttaggtttatgtacattttgcatacgtttttctcatttgtgacatcaatgtctttcatagatcactttgggaacttttccaatggtttctttcttgtttcagagttgcttgctgattcctggtcctgttctgaaagtggaaagtacatttttgccatcatctatgttcctaaatcagcgaatatggggttgatgttatgtagttttgtggtgtgccaccattaattactagctgcaagtgaaaaattactaatacttagttaagttttttgtttgtttgatctcttctgtggtattaaattcaaattgttcaaggcctttttgtaatactagataaatatgcagaggaaacaaggatttgtggagcttattagtaataattatgtctatgatttggcctaattgttcggttttctttggacatgtttttatttgtttttgatattgtaagattgcactattattcttaagccttgtaagtatattctcttgttctatgccatgtttcttatgattttagaataaagagccagcattactatttcgagaaacatttggttgatggtttactatgttttgttcatgccaatattttaacaaacctacgttgctgatatcaatttagactggcatactaattttcttgacctttataactgcttgttataggaaatctttcttaaacagacagccggatcatactcctttgattgtatctcattgcatggatcacatgcaaggaattcatttaatgagtcattgccagactggcatgcagctggagagatatgcttttacgtaacttccagaaaagatgaaacacttttctgcaagcttcagaatcatggttggaggattatttgtattggtgagtgtttgtttttgtctagacagggaatcttccatattctaaatatggacctattccttgtgctttcttaagctcataatcaagatatgtggttcattcttgaattaactgagcacttgcagctgttatgtttattttaattggatttcttactacaatctaggtgttgaaaggggtgggacaatggataaggagttgttgtttattgacaagttggaagagttgccaattactatttgcagcttcagcaagaaggttgtttgttctccgggttctacttctgagtcaactttattagggtgattgtttatctgcatagttgatctagtatctccatatgacccatttagaatgtttttattatttgcttcaggtgatgcgctgcacaccagtcctgatggttggctatgttatgaaaccatctcgtgaagaagattttgcaaaggcaagtctgggtttagaactagatgcaggtattatattgaatgctgcggttgcaacttcatttgcatgactacttgttttggacagagaggcgcattccctatgtatcctactcaaaatggattgctttttgttcctctcacatttgaacttcctttggcacctcaaatacaagaagttgatgtaatcctccataaagcaactgatgagatcctcagcattgagccagactactgtttggattttccaaagggaatttatttctccaggggaatgcaagaactagaaaggtgattgccaaaatcaatatatgtgaggatctgatattatgatagttaatgaacgagaagcagttctgttcagttttgctttcacatctgaacatgaaaaagaggtcaacatagtttattttgttttgttatccaagcctctagaatagattttagctgattcaatctgaacaccagtgtgaaggagttggatctatgtttctggatggtaacttgttagtaataggagaagagtagggtaatgagccgtgaacaatagtgcacaagtgagcaacaagggattactctatgtttaaataatcaattttgaattggatctgttgctatgtaggtcaaataagtggtgaataaggtaaaacactaaaaggtataggaaagttatttttgtatcagatctgaattagatccaaaaacaaaaatctctatgaggagggagtgagggagagaaaatgtctttccccagaaccctctaaaaagggcaaccattattaaataatcatttcaagagtattcatgtgcttgtcttcttttgcagcaacttcaacccttttgcaaatacccaagatatcctaagcagtgagttaacatgaggttgtttatgtctaatttgatcaattgttaatcaaacaaagatatttctaaaccttctattttctacccaaaatctaaaaattaacccaaaatttaggagcttgatcaattttgattcctaatgtaccttataaatgacaggtttacatgttatcattgaaatcagtactgccagatgtgttcctgcatcagtatgccctgtatcctgctacaacttaagtgcccatgctgttaatttacttttgctgatagcatttgtagctcaaaggatatcaacaaatcctcttaagctgttcttttgcttctccagtgatcaggttaccaatatcagagtgctattttctgattataccataaacattgtatctatatagtttgtttagttccatttgaggtatattgctgatagttgtgcctatgctagcttccaaatacagttaatataaccagcattttttttctatcattttgttcaccttatcaaactggtatctcagcgtttgtgtcactgtttcacccaattaatttaaaccctaagagatctgaaaatctagcacctgtgacagcacacattttctgtcagattaagttcatttgctcataggtgacgagccaaataagttccatcctggtagttcactaaacaagttggtcattgtatttgttttttttccattgggtctctaactgtttttgagctatctattgctgatcattaacatcagtatccttctgtaatgaattttatttttatgcaggtctatccaggaccatccaaattgttgcttaatggacccacttgacaatatataccctttacttgatcgccataagatccaacaaattcttcttggattgcaggatctcaatgtcaatgatcggtgtagactccgggcaccacattttttaaaggtctttttctcagagtggtacctgtttgctgcctgaattgatctgtgcaattgaaatgagacaaaataaaagaagtactaattagcgttccattgctttttagttgcatgcttttggtaattgtcacaaatcacatcttctggttgactagccttcttctccccattcacttatttatgcttacatgccagttatcatatataaattaaacaatctgttactgtcttaagacttcatgcttcaacgatcctcaacatggctaaataaacaatagaagcaacacaaaattgtaagcagtagcaactgggccatacaattgatgactaatgcagtttgcatacttgttcttgagcgtgtaggcatgatacagatatctcagaaatgcagtgcattcattttgttgcagctcccctgcaaaattgggattatttggagaatgttatgcagcctgatgtcactcactatccaaggtggcaagggaggaatgagaaatttaccctgctaaaaaggccaaatccttatgaatagcataaaactcttatgccacatcggatgggttattgagttgatatcttatcggtctgcatggccatactccttggatatggactgtgtcataatctggtttttgctgatttttatcactgaaggcgccttatttcttttcctctctttgagcattttcatgaagccatgcactgctaacacagcttctaggtgttccagaacgtgccttagtggttttatgggcctaagtggttgctcaaggcacaaaacctgcattccaggtcacgtttgaatatttttggaatgaatcatactaatgaatgctttctttgatggaatttgtagcaataaacatcatccttttaatgggacagcctcccaggttaatctctagaacataattaacaaatatgataattttgttatggtgctagtcttttgcaaatctattatacaaggtttaaaccactggtatcgggtccatactggtcttgagctggaacagtatggtactggtacagttggcacagattgaaacagtcattatcaactagattaagaaggtattggtactttctggtacatacctactgttctatggactaacaccaatgctgaccctatactgaaccacctgtatttgaatccttgctattatgtttgtgggtaaattataattgcatattgtgcttaattatgtaggttgatatctttcatgatcctagtctaagggatcgactattagaagctaatttatcctttccaatcattgtcaaaccacaaatcgcatgcggggttgcggatgctcataatatggtattctcttatcgtcttattccagtattccccttttcttgcccttatgaataatgtagtactgttgtaagcagaatgtagaagcatttgtggtgataacttctttcagcaattgtcatttgtaatgagaagtggctcaatctgcaaatggttttagttctgcaaacttggtcaatctttttatcttccagttggctcgactgacaactgacaaagtgcaacttcggctataaaagctatttagttgatttagttattacctatgagttccaagataacttttttatcttggactacaagaaagaaaattacagcaaaaaaaaatttatctccacctttcagcttttgagaaatggatatactcaaatcattgctgttattatctttaaatcatcattgttattatatctttatcattcttacttgacaggcaatatgacctagcattatttatgcaccatacaatttagttaagttggcttcttgctcaaatcattttttgttttcttatccttcctcacaggcattagtattcaagtttgaagattttgtggaccttcctgttccacttccagctattcttcaggtaaacaagaatcacctgcagatgatgcatcataagtttatatagtacaggaaaatttatacctctggcatcaaaatgaatatcaagagaaattgcgctttgtacattgtgattcagttttttacagtttggtcttttatagagttaatgtttcataagttattaccaagacttatgtggaacataaactttctgataatatgacatgctttaggtgttcagatgattacactgtcctaaaacaaaaatcttaaaagtgctatactaatattagctttttttggttttcatattggtctctctctctctctctctctctcttcttctctatacacacacacacacacacatatatacatatacataatatactatatatatacatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaaaaccaaaaaataacttaaaagtagctatactaatattagtcttttttggtttttcgttatattggtctctctctctctctctctctctctctttctcgatacacacacacacacacacatatatacatatacataaatatacatatatatacatatatatacgtgtatatactggtatatacacgtgtatacacgtgtatgtacagcgcgcgtgcgcgtgcgtacgtatatgtacgtatatatagtcgagaagtatataaaatgtaaatcaggctacaaactagaactaattttgcttcaagttatgttttttcatggttcttttaaagaacttgagaataaattagatttgtaatcatggttggcttaatgcatccttctttgccaattgtccaaatcaaggcctattttcccacaaaaaggaaaaaaaaaagatggcatgtaatgttctcaaatgtttacgtttgttacagtatcgatcgctctccaaccactccacatgcttttgtgggatcaggtgttgagcaaactcttgtcaggtcatggatgtcaggtccattgaggtagagctatttagatccaacaattgcgagcacaagtcttggccaaaaacagtgactttaccaaggcccatttgacgatcaagtattatagagaagatgagggaataaggaagaaagagacctacagaatttttagatgcagtgattctatggtggctgcctggttgctcaagtcaaaatcagacgtcatgcatcaatacatagtttaggtaaagcagtcactgcagtgccctcaatatgagaagatccagtagttggagtgtgaaacataaggtccattatagtccagacaatcgcatcaaatatatatggactacaattagtaaggtggcaaccagataaaccacattgcgcagttatgttcccagcaatccaaggtcctgagaggggcaaactggggacagacctaccttttttctttaacataaagttgctgcctctggacttaaacccatgccattgcacttgtcagtgcaagcctttaccattgtaccaagcaatgggccctttgaaaaagaccattacccagttatgatctcggcaatctaggattctaggaggggctggctgagcatagaccaccctttggctttttttttccgcataaagtggctgccctaggaattgaacctacgccatcatgcttgtcagcccaagtcttttaccattgcatccagcaatagcctctttgcaaggtgacaattggaaaccttaccatcaaccatgcaaaataaatatagaaaaatgatatatgaatcataatcctaagccaaccctagcatcaccaatattatgaaatgggtcatgtaggccattaagtcacaatggatcagtcctacttcaattgctcttgtggtttgcattgctttaacatacagttgaaatttatcaaattgcttgtgtcataattagatcacttgtatgattggattacatgctgatggtgaatatgatatatcttagctgatcaactcccaataggactggaattggtcctgggctggcccgaggaccattgttccgggccaactttgagttgtgttatgggttaggcctgaaagattttggactggtttggagttaaatacagagcccatatgttctttgggttgggctcaggtatatcattggcttgacttgggcctagccagagcccgagcccgaatgaggcccaaaatggagcttgaactccagcatgaaatggagtccaaacttaggtacttgtttatgaattgcttagaagataggcatgccatttccaattgtgttatcaatttgcttttctggtaaatatgttctgatcatcggatggttgctaacatgaagctacagtattttatcagaaaaaatgtgaagttgcagtatagaagattgaaaaattaagcttcaatcgggtttgggccagccctatttttatcccaaatggataacttgagctgccccaatggggttcaggtcgggcctgggagaaggctcggttgggcatgggctgggattttccacaagtttttgggcctaagcctggctaggaggtaggaggtagaaaaaaattttaggctgggcttgggtagaagagtggcctggcccatcccggcccgttttcagccctaactcccgaaagaggagtagattttgttaaatgcagacttaaatcaattgagcttgaagagtgactatagcatgatacacaccaattatcagctgttggattacctgtatgattggagtacacatagcacatcagaagatcaatatagatgttagatgttctaagtgatttgtgatccatttcagttgtgatatcttaatgcatcgttggcatcaataggttatccagattgggctacatcatgcaagtttgattaaccaataaattagttctttgtgcttctaaatggtgagagcaacttttctggacagagaagattagagtccaagaagacctttgttgatggacgagcagaatacatgagaggtacaaattttgatggataataccctgatatctaaagttgctaggttgtgataattaaagaagatggattcaattcttaggctggaagttttggtcgtagtcattacttaacgaaaaatattgcttttttagaagaagaatagtctgaattgctgggaaaacatataacagcaaaggagggtagtcagataccttgaggagctgtcagttctcaggtttcattattaacacatcttttttgcctttaaatctgttgtggaaaaacagcccggtcacaaaacctgaaaaatgctttaaaatctaatcaaagaagtatttttcctgatttttccatcaaatacattttgcccaaaatcaagttacaaattagctgttcaataaaggtcagagttgtcagacatttgaacaacatccaaactcaattttatttatttatttatttttcaattcttgattgttttccacctttttatttagaaaaggaagaagataaaagatccggaaatccttgttgctctgcagcagttagtagagataagaagcaatatttcggaagatggcttcttggctccctgagttgtcagacattggaacgtccaaactcaattttatttatttatttctttatttacaattcttgattgttttcaacctttttatttagaaagtgaagaagacaaaagatctggaaatctttgttgctctgcagcattagtagagagaagaagcaatatttcggaaaatggctccttggctgcctggctgcctgccttatatcttttatcaatttgagcatagagaagtatatcgctttttgtattagtattatatgtttccaattttacttcccatcaactttctatatcttatttaatatttatgttcaattttttgtattataaatatttttcttggcatctccttgttcttacaattcttttaagttccttattttaggattccttgatcaccaatcacccccatagttcttacacataagcagctctttgcatgcccatccactacctaccatcttctaaaacatcggtataaagccatatgtttctaaatgcccaatgaaagaagctaaacagagattggaaggatgaacttgacaaaatgcaagagggtgggctcttgtacaatagtgaggttgctccattgcgatttgggcatcatgggttcaaacatgaaaacagcctttcagcatacgggggcaagactgcttacatttaaccttctccaaaccctgcagtagtgggagcatcatgcactaggatgcccttttaatttaataaaatgcaacaaattgctagggataagcttttggcgtagccatggccaatttgaagtttgaaacctgagtggattattctagatatgcatgtttggattactcctgtatcggtgagttgtatgagaaaattgacactatttggggtctgttgaagaagagttttagattggggttccaatatactaaacctattataaccatactctagtgtataatgagatgcatatctttgttactatatggtggataaaatgaaaatgcctttgcattgccttgctttcatccatacacttgaatttaactcatggaaatggttagctagtccaaatcaatagacatggtaaaaaggttggaactcctttttagttgaggtggatcataaaagttatctggaggcacttgacaagattattggagatgaaagttataattttgataatagtagaattacttttattaattcgcagttattaatagagatcctaaatgcaattacttggtggaatttatatgaaatgtagaatattaggttaatgttttggtagtaagagtcttcatgaaattaaactctttggtgtggagaggagttgaaacctgcaactatcatgcatcctaatcgctattcacagttgctgtgtagaacaggcaaaaaactgaaacctatataatatcttgagaattctgtgcctgtaaaaattcatctaataaagttcgccccatgattctaaatttccaattcatcctaacaaagtgtaaatggatgaagaaaagaaaagaaaagatgagaaaccaaccatccctccataattggtttctggtttccaattccaggtcttccacaagcctcccatcttttatcccatcttgtcaaggacaaaaaaaaaaaaagatccacctattctctccaagtaaattgggcctctaaaccatctctccaagacctgcaagtctctctcttcttcctaatcccattaattgtgtctcatctttcatgtgactactctcaatgttgtcgaaggcgcacctaaggtgctgataatgcaaaggcaccaccttcacaccttgtctgccccatggctaggcgacttcacttgggcattcaaaaagcatgccttttatatgccttgcaggaaaacgcatagaaaagtacattgtactgtttttgattaggaatttggtgattaaccagaagagagaagggggaaagatattgtagaaaaaaggagagaggtagacaggagattaagaggtggacgccatatagatctagggtttggagtctttggacaaatgcactaggtgttctttttcttccatttgataaattccttattcttcctgttcttcttctctttttacctcttactctcttttcctttttttcttttgggagatggactggccctcctctgctgctgcaactattgactgatgcttctgtgctcatatgtatgtgcgtatgcatgtgtacatatatgtatatgtacatatgtatctacaattctacatatacatatatgtatgtaacagacacacatatgtacttattatgtgcatgcatatccagatcaatttgttgttcctatttcttttccacagcagctcagaagttcagcaatgatttagcatcaaaaactctgctttttagtctccaccataaaatgtggaattgggatgccccattattttttactttgagcctcttacgtgcaattgggagtgtgtatagtgaatctacaaaagagttacccacttatattttaacattttgttggactaaaatgctacattcttaaggtaatacataacataggttatacacttgtatgtaaatactggtgaataaattctatatatttccatgcaatgtacaattttgaggaatgccatcataaggaaaagtgaaatataggttttgttatctggcatcatatggaaaaatgaaatataggttttgttgtctggcatcatatcttttctcttgcttgtcacattgccgctgcgctcaggcttcaagagaccttggcacgttcatgttccttggacctgtgaccactttgactactctctctccccccctcctctctccctctctctacacacacaccttggtggagagtatccattccatcaagtatctatcatccgacccaagtaattgagaaataagattaccatgattgtgaggatttgaattataaaaatttaaggccagtaattcctttagatttcatcctccaatcctcttcccctttttttgaacttctatacaaaaatatatttcttatgtacaaatatgtacaggtatatactacatttcagaaacaagatatagagtgacatggtttaactgtttgctattgatttttaatgaaaatatatatgagaagtttttcttcgtaattaattatcattatatgtgattatttggtaatataaaatattcttttaaatcattgaactcaaacttatatggaaacccagccttgttatgaaagcgacagcactattatcaaaataacagaaaatttcaattaaaaatataagatgtaattttaaaattgctattatgaatattatatattctatttggtgtttcttcacgttttcactcaaggggccaaagaaagcatagacttctattggagcaccaaggcgaaaatcctggctctacccttgcaatgcgtaccaagtccagcactccagtttgggaagttcaaaactagacctaaatggatgggcttatattttccagaccatcttggtacacttacccaggtctgcaaaatgcttattctttggaacttaaattgcaactagccaactatactcatggcagcttgatgaatacacttgacctgataggcctggcttggccatgcacatcagaagtcttgtacgagtgcctgctgatctcccatacaaaattcaagctgtgtatttgaccttaaaacttgtacaaggtttggaagcattgctttggtatttggactcgacgttccaacttatagttggctctacttgctgcactgctatttcatttgacttttagcattttagctttaaattgatcccttaaacaacatcatggagctgtagttcatggaatactaggtccaatgtgggttcttttgttgaaaacttcttgtactgataatgcaggaatatgtggatcatgggtcttcaatatttaagttttatgtgctgggagacaaagtatttcatgctgttaagaagtctatgccaaatgccagttttctattatcagcatcagagaaaaagggttctgcaccgattatttttaacaggtattttggaactttatgaccattctgctagcctctgcacattatgcctgtgtttaaaagcagatgaaagaaccaaaaactacaatggataaacagccgatatatgaacttccaatctagttttacaatggatgaacagctaatatataaatttctgttctaacttacacagtctgaagtctcttccagttgctactggggaccagttctcagcaggtgggccaaaggctgctaaactatctttagatgtggaactagtcaataaagctgcaaaacagctaagaagacaacttggtcttactatttttggatttgatgttgttgtaagttatccatgcctttctctactgaaatgtttaagctgtaatactgctgctgctaggtgcaatttaacaatacccaccatgatttacatgataagacgcttattagggttctctacattgctgattaggaggttttttagactattaatcgaagtacgaaagattcttttaagcaaaatatggacagcttaaatgatgctcccttattgttgtgcaaatttcaaatttcagattcaagaagtcagtggagaccatgtcatagtggacttgaactatcttcccacttttaaggaagtccctgattctgatgctgttcctgcattctgggatgcaatcaagagcacgtataatttgagaaaggcaaactgagtggtagccaattgcttttgattgtgctgaaatttagtctttttcatcatgggtacttggtaagtacaatattagaacttaacccattcaaatttatcgcgggtcatgagataaactgcatttcctagacataccattttggaataatttgcttgggtcataataaatagatgaacgtctgctccacaaaattcaccatgggctgttatatcatcatggtagcagatatttgagctttagttgcatgcatgatggagtagctgggattatggaaatgagtgatgttcagtaatgtcttgacaaagtttcctatcttgataacaatgtagttcaagtttcttctgaaatcttcatttggcatggttacgaaattcacagagaccctattttgatcactttcttttttgagaggactattctcatcacttttcacgttcagcctgcaccaaagaataaaccttttggaagacttcctgggtagtgagtattttcggaggctgtaggcataatagcttctttcttatctggtacacaaactatttagctggtgaaaccctcccaacccatcacagttaacgaacaagatataaatcatgaacagctacataaatcatgattctcagattcccatattccaagaaaaaccaaagccaaaacaaatttcagcttcagcatagaaatacaaaaacctttagaatttcctgaaatcaaacataccaagaagtggaaaaattgcggcattattcagagatatccaattaaaattgatgaaaaatatatgattatataaaactaaagatacagagcaagagatcctacttaagcaaaccgacacttgaacaaagaattcatctctttcagctaccaaacattcaagaaaagataagaacaagaatcaaacaccagtccgtaaatatcagactaaacaaaatatacatctaattgatgcacagagagagagagagagagggagagagaagaagaacagtgacttctggtccaagaaacagtgagaggccccttttgagagggagagaaccaggcagtcggtgtccggaaggtagtatataaaaggtgagtggatctgctgccatttgaattgcaagaaaccatggtgcagttggagttagagatcgcaggcccactggaaaatggagctcagaaaggtgtgtctcagtttctttatcagatccacaagcggatctgctgcaattcatgctgcattggatcctctccatgccaggggaccatcggattttaaatcttttttttatatttagtttggtttccactgcctttactcgtccatccattggttttggtttgttgggggaaacgccttatggcatgttacagtaggggaaatttgttgggggaaatgccaaattgcataccaaagaataaactttttggaagacctctggtgaatgttcaatccctgttgtactcctatcagcatctagcatgtaacttcagatgatctggccgatagagcaccttcgttgtggttcttaatctattgtcaaatgaccggaaacttcatctgtagtgcatcaagaaatgtatcccatcaatggatggaagctagttggtttttgatagtgatttgatcttgatgttttggtccaggaagttgaaggtttttcataaagaaagccgccagtctgcttactgtttctaaaataaacctgttggtagagacatctagtctatcctcaaaccaaattgctttctgtcctaaggacctctgttatttcacttcctccaggattatacatcaaaacttttattctgtttttacagaaagtaagaatatacattgtttaagtagtcattttcatcataccctctcttgagcagggccccttgctgaattataaaaaacaaagatcgccacttaaattaaccagcagttttacctttcaagcttctggtgtcactgagttgtgtaagaaacttgataagaatgaatatgatgaacactgtcaagcagcaaaagtcccatgtatattaggaaagtttcagccgtagatcttgttcttcagtacatcatattgctatcagctatctgttgctgtatatgacattgtacaagaatgacatctctatctacaaaagtttacatttgcaatttttcttgcctgtttgagaggttgaagttgaaaaagaaatcaccagcattagccagaaccagtcataccatcctaagagggaatccacatcaggtgtcacaataacatgcttcttgatattgcttagattgcagctatgctcttaacgttgatagctgatgcaacatgttgggtaaatttgatttctgcacatggagaaacctgcaaagcaaataatcaacagtagaaaaaaaattattgggattattgaagatgacaagcagaggagcaaacataacaatccgagcttcagaatcaagatgtgttcttcgtgaaattacaagcttgaaaccaggagttcctcatgcagtactagcatataaacacagcttgcatgagggttcaccagtaactactatttccaaaagatatatttctatagttaatattggtactctatcctaagctgcagcctcacagcagagaattctggaggcgtgaaggaactcagctttgctgttgttaaatcttaacaaaatttcctgtccaatcacaaacatcacctatgcagcgctgggaggatggatgctttggaatgcaatagttcccagatgctattactgacaaatctatgctgaagaataaacaggtgaagttgaaataacgtacttgccttaaagatatgaattcctactttacaatgccactcttatgcaccagcatcgtcctgaatgttcccatcagacttctttgaagatttatcctcaatctgtttcaatatgttgctagttgcatcccttgcccagtatttcccttcagccttgatttctttccccttaacagcatgagcagcagcagcattaggccgctttgcaactggaagagatgagggcatctgaaaaaggagcaggtaattatcctcactttcatcctgaggaccaacaaagcgttagggcattacatatacccacaaagtgatatttttatagtcaaaatagtataccatcaggccaggctcattttctggcttaatcttagttcggtcttgatctgaatttttgttttggtctggatgtggagataaacttggccaattcttcctcggctcttccaaggagaaatctgaaagcagcgttaagttcaggtctcttcactctttcagggtgcatacgttttgagaactcaccgtcatctgtgtcgcctgaatccagagggatgccctcattctgctgctggaagtgttaaacacaaacaaaaagcggaatcacatccatttcttcgcacctagctacctacacactgagcggcaaaaaagcaacaacatagaagggcagatattaggagggttagaggtccaatcactcgccgatggctcagcacattccttctttgatgacaaggctaacagattcccaccatctgcaggagagacatcacggcattctaggatggtcggcaaggacagaccggtagaacgttcaaatcagcaaaatatagtacatgatatctatttcaattaactaatctgagaacatttcctgtatcttgcggcattcaagtcttgctaaagctttagtttttgggaaaaataccaacaacaagtagcaaaatcatcataattggacggtagttaagaattgaaacgtgacccttctttgaatataaataacatattcaggtagtcactgcaaagcagtttttctctatcctgaatgtggctgtatcttagttacatcatgaagaggcaataactacacgaggatgaaatttaggtgaccaaacatgcatcattgccaattgaactactataagtgcttagaagacagttcccaaagctaaactatgatctacctggatcactgttatctgacgaagagtgactagataatgagttcattttctgcagcagcaagtgtagacattgaaaaaaaaaaaaagaaagaaaaggcagtccaatacatgaggcttccatcattatggagtctggagaggatcggatgtatgcaatattatcctcacgtggagagattgtttccacattttgaacccataaccctctagatcacagtgaagcaaccttacagttgtgccatggctcatgctctagcagcaagtgcaaatgtaaacatagtaaatgcttgttcttatgttgcatgcgaaaatcataataagatcagaagaaccctgtcactcacccatggctgatcatatttttttctttgatggggtgaccatatcaagagcatctgcaggaaataaaaaatattccattgttggatgatggtaaactaggtgcttggttaaagcagcaaatgagatggttgttgtacaagtgaccttgatgtttgcttcaaaaatattgccagcagaaatgccaaagggctttgcagacgttgattccctttcatcaatgtgcactgaggtacacatataggaccccataccaagatttaaagcatggatttatgtactggctttttacacagattcagacatatagcatacagaatccaatgtatagatggggtctgaagccggccatacagatatgtaggtactgacatgtcttaagacatgtaacttgagttcatgaaattcagcttgtgaagtatttaattaaaattcttgctatactacagttgctaatttgccattcatctatctttggtgcagaacaggatatgaaacaagggagagaatttgttaaccaaaagataaaccaaacccacatcccacccctaccattctcattcagcctttccaaaaatcaaaaatattttcaaagtttatcagatcatatcaaaagatttgtgcagcctccttggacttattccagatttctcatgcttaccaggaggccaaccaaccgactgatagcttggctgggagacccgacgatgggtccttcttgttcccctgttctctcccctgcaccaccagtctgctggttatggctgatttggcgggtgtttcttcttttcgttcttagtttctttttcttcatggggttgtaccccatcttatatgagtgcatccaacaccaatctctccaaagaccagcttgtgaaagagagtgaacgcaagtctttggcttgataagacatagccggcgttcgaaaatcaagctcttgcttatctttgaatgagactttgtcctttctttgaacgtcttgtatatccactaatcataattttgaagtgctaatctagacctatctagctgctcatataaaaaaaaaaaaatccaggaatagattgtcccactttcaaaaaatcatcattgcagtgcaaaaatggtgttgtttagtaaggaaccaaaatttcagatggtcaatgtgaacagtgctgataagattctctgcatattggtgttcataggcaagctggtttataaaatgttgaactgatgagaacaatacgacaagcccagcaatgacttaaaagatctagctggattctataaatacgaagttcttgggcaacacatgggagcatcaatcgcaactggcagtttacttgcttaagaagacaaaaatatatctattgatcataatacacatgtatttttgatgcatcaaatcactttcaatgaaaaaaattggagatattcacatagtcaatgcctttatatgtgttgatgtacaaggttcgcaactccattaaagaattggaacatttcttaagcaataaatcaaacatagccagggaaatgaccttctactaataatattttacagttggcatttgggatgatgacctttaaaaataaggcctttgctaactatataaggttggccttaggaacccatccgatatccaaaaacatgcatcttcttcaatatgagcatcttcaattacctttctatgtttcctgtctgcatttatgtaccctataggcctctgttgcacataatcgcaagtatatacaatctagattcattttgattgcttcttcccctatttgtgtgaccatgaagctaccattgcattggaatccacccaggatgtacaagcccttgatttagtccagttcttaggatgcagttgcagaaatctccaatttatccatctgtatcttcatttttattttatgtacaacaaggacaacatggtaagagcttgtgcctttcagcatcttattggctattgagtttaactaaaacctcaactatgtatatactggtactagtagcatttgatatgcttatttttgccataaatttataatcattagcctctaaatttgatatgcttatttttagccataaatttataatcattagcctctaaagaaccactccaccatcacagattttacatgctcctgtgacattgggtgcaaaaattgcttccatgtcacataaaaagagtgccatactaactgcattttatggcattttatggcataccgtagaatataattaagcaccaaagtgatgacatcatagcatcatatttaactacacatactgagacatgattggaacactttagaacaaaattttcaaatttaaattctgattaggttatttaattatcccagaaggaggttaccactatctaaacaacatgaattattgatgacactcaattacaagttgatgatagcacatcttaaaagtaaggctatttaagtttgcattaaaatacatgggtgatatatccctgatctgacttgcttctttgccagattgtcgtcctaagcacctgagtcatgctcctggtaaactggatatttttatagctagcaccaatcatttgtagtcttacaacaattcacacccactaagagcctcagtcttgtggggaggcacctaatttatccaaattgaaaaaccatcatgactggcctgtcaagaggctaatgctttgggagcttgttatcatgaaaggtatgcaagagctgcaagtagtctacaaaactacgacattcttgaatggtcccatgaagtgcttcaaaacttgtttacttctggctagttctagagtatggtattgatgatggaaggataaccattctatcttgaagatgactgtagcctgatatcttaggatcaaagttacacatccaaatctgtaaaaccctcccttttctgcatgttgcttccaacataatcaaagttgttatgactggttaagaattttcatttcaagcatagtagcttcagcaagaggaataatattttaggctttctactgggttctaacagcattgctttagcagtatcctaagatgtgtaaatgaataattttttctagtgatgattattttgtatttacttacctacacagcatattataagctaatttgagatgaacagcatcgtccagacagcaatttcctagttcctggacactgaggattccttctctccttacagcaagtatacacacttgatcaatcatgcccttttggataataggcattagtgttgctccacaaaagctccatttgatgctaatttcaattgagaataaacattcaatatgcattgtcattattggatggctctgtctggtcgccatctcatgaccaaacagtgtgcaaacaatttgcatggttaatttattaatgttcctcattttattcatgaacttctaccaccatgtcttcaatatctccaaacaacaatcacttgatccctcatgttccatcttctttaagctcatccaacatgaataaaaattagatccacgattaatctgattttatactccactatgagcttctgtgtctttcttgctgactcccttatcttgtggagaaaagaagaaaaactatatcatatctcatgctagtcaaggttgaatatttgcacaatctaacattattatgaaggttgattggaatatctgaatgtttttcttcaaacttagaagttgcctttcactacttctaatccttatatcatgacaaccatagtgttaaatggaaaagaactaagcctcataattggcagcatttacaatggagcaagatatgtatggacttgttgcaggatgtcattcatttttatgctcatacctttccgcttgcattattatgaagatttggctaattaggaagacccttggaacctcaagcatttctatcatctacctgaaaaactattagttttctacattctggtccactgtgagataaaggaggcaaaccagaaagaatataaagaggcacttcatcattttatattgattatgatatatgtaatacacataattgaaacaatgcatttacaagctatagaactaaggtctactatagatccccaaattgtacaaaacctacctttagttgtttttacattatgataacctagcaaacatataaacctcaatatcctcccactactacatgctttttatgcttataggcccttgttctttggctaacattttgatccataagtaacccaaccttttagctctttaatactattttggctcaagtctcaattagattatgcatgacttgcattactctggggattcacatacagcatcaaaaaaaggtacaaggacaggaaaagaaataaatccgtatcattatccaattatatagatatgcatttaaaaaatttagctagatactccacataattggcccaattttgttaacatcagtagattgatggataaaatcctaacctaaatttcaatgatcggtgtttctgcattttcaccaagctagaacatattgtccgcgcaacaggaaagaaaatgcaaaaactttttgagaatctaaaattgagtagccaatggatgcagactgatactagtttttagtttggttttatagcatagccttggtacaaaatcatgatgagaattgatcgtcttatcaaatacttcgaacagatagactgcaaatgtcatgcattattcgcctccgagctttttggtgcaacacgtaggggcacctattagcagaaatcaaagaacgtcaagaagtaggagtgaccattttcagaggctgtaggcatagcttctttctcatcttgtacgcaaactatttatccgctgaaaccctcccaacccatcacagttaacgaacaagatataaatcatgaacagcaatataaatcaaaatcaagatgctcagattcccatattcccagaaaatccaaagccaaaacaaagttcggcttcagcaccgaaatgcaagaacctttagagtttcccgaaatcagacatgccaagaagtggaaaaatcgcaccattattcaaagatatccaattaaaatcgatgaaaaatatgtgattatctaaaactaaagatccagagcaagagatcctaccgaagtaaacgaacactcacttgaacaaagatttcagccccttcctgctatcagacattcaagaaaagatcagaataagaatcaaacaccagccgtcaacatcaagattaaacaaaatatatgtctaatcgacgcagagagagagagaataccaagaagaagaagaggagcagtaacctctggtccaagaaacggtgagagctcttttgagagggagagagagagtaccaagaagaaggagacgaggaagaagaagaagaagaacagtgacttcgcgtccaagaaacggtgagaggtctttcgagaaggagggaaccgcgcactcggagtccggggaggtagcatgtaaaagaggtagagtggatccgctgcaatttgaattgcaaaagaccatggtgcagctgcagttggaaatcgctgccccgctggaaaacagagctcggaaacgtgtgcgtcagtttgtttatctgatccgttatctcttgcaagtcatgttgcattggatcctctccaggccggggagccatcggattttaaatctgttttgtccactccctttacttgtccatccattggttagttcggggaaacgctcgcatcacaattggggaaattagttgggggaactgccaactggaatatcacgggaacccggctgcaatgagccaataaccatgagtctatgccacccaattgatgggaagaggattattatgcttaataagttgattttgagtgagaagaggagcttttttttttggtagaagagaagagcagtttaacgcaaataaaatttaactctggttaaatcagtaatggtagtaaaacattaattggatctaatcaacaaaaaaacgagcatcaattagattcttcctttagaaagagattttgctttcggcttgacctcctatttgcattgtataaaaaaattagaagctagaattgatcaatttacaaaagttacgagggggggctgcaaaatatgagatggagtcttcatcgttgattgtagatgatctaaagcacaaaagtttcacgatacatggatgatctatgaattgaagcaaaactctctaaccaaaatctaaggatgcatttggttgaggtatgttagattaaggaaaaatccaataacttttgaaaattatttattttaaaaaataatttgtgaggaaaaataaattttatcatatttggtttgtaaaaaaattattctacaagatagaatggaaaaaatattattatgtttgattagagataattttatgtaggcatacggccatattttcaataatatttttgaataaaaaattcaagtaatagcatttttttcttgatccatttgttagccattcatggtctacttacacgaatgtcatcaatattatctattttgaatattaaaatatatttatatgagttaataaatatttttgaattaattatatattaataaattttacgatggtttgatatataaaagaatatattaattattaataaatcatatgttagatttattgataattaataaatattcataattgatctactaataatcaatatttattaataaatatattaatatattgttataatcaatattaattatatattatgattaatattagttatatattaatataatataattgaggatattttcatcaagaaataatatttttagatcaaataatcaaatacaaaaaaaataaatatcacatttcttgtagtatttattttatcttctctctcaagaaaataattataggatctatcaattattctatcgcttcttttatccatttttcataccaaaaatgataatttgatagagaatttattttttttataccaaattacctcccaacaaatgagctttaaattggagagaatgttggcttaatatagtgtagcctcctccaactggctcaggcaaataagtcataatatagtcactcatgctaacaaaatttacacatccagccaccatgtcacgaggggatacaaccacgcccatgcaacacataatcctttttttttttaattccttttcaacgaggaggtaaccaccaaatctaaaagaaattttttgcgcggtgattggcttacgcacagaactaagtaaaaaaaaaaaattttccacactactatctggtttcatgcatgagccaatcatcacatgcggtgcatacgttctgcatcacatcatgcggtgtacaaagaatttctcccaaatccaaaagctaggacaagccccaattgtgtgtacatatggccatattttctcaaattttctcaaagttgtgatgaccaagtgctctctggtgcccaactatttgtgaaaaatgcataactataatgcagatgcacttctcttaaaatctatgagacaggttaaaaaatgccctcgactactagcaattagaaaacaattacggaacggtcgttgagtcataatttaaacatgaagtccctttttctcttaccagggcccatggtctctctccgattcataattcgttctgccacgggcgtaagtttctggggctgcttgatgccgcgaaaaccttcacaaccgacggccgcataggcgtcggtgtggcggtaactcaccggttcctcaccctccccggaataggaccaggaaaggcacctcaatagccgtcttcgcggccgtcggcatagaggccggaagtgaccgtggagaagaagatgggattctggagaaggggaggaaatcgaaggaggcttttgccagagagaggagaggaagggcggtggaggagagcctccagaggatgcgatcatggcttcaggagtggagaatatcggagtgagaatggagaagggatggttttaagcataggggcccaggaaacgcgtctgaggcctgttcggatgatcctccgggatttttagtattggaaacacagcttggcccagcccatgttaatctaacttttctaggcccatttcatagggagaaaaatagatcttctgagatgcgtttttctccctataggattcaggctgacccactttgaacctatttttgagaattctataaatctgggcctgacccaggctgtggtcctatgatcatgctggattatataggatcatccaaacaagctgctagccggtgtgtcgaactgctgctaatatctattcaagaggtcaagaagaacccaagtgattttggtcaaaagaaaatgcagcatgcgaagaattctgcaccaacaaatggtagtttaagtattaacttgagcccttgcagccctcctggatgaaaagttagaacctttacaggtcaattgaactctaaagcaacaaccttctaaaaaaggggagagagcatggacaaatgtagactatgttagaaagctcttgagctttagtttgtatcttcatcggtgccatgttgattttaactcattgataagtagtagcctcctcagatggcaattaaaaattcattttcaattgtgaaccaaactcatcatctctactttttgatctaatgaaataactagacaaactagttaaagaatcaattatttgctatttgatcttattctgaaacttttgccacacataaggctaaactctaggatgattgtttgatgaatgatagtgatccaaatacattatagtgaacatattatccaagatttatgtaaatactaattttgaaactcaaaattatattaagatactaatgaatttgatgctgttatattaatttgatatatgcatgtgcgtaaaaatatgcatatataagtagatgtgcaatgcttgtgattgggccataaaggagtacttgatgaatggatgtaattaatccacattagaatagagtgttttcaccaccatattatgttttagtttatgtgaatttagatatgcacttcgatagcttgttaattcggcagacatttgcataaaactaattatataaacttatattaattatacaaaatatataactataattatctttgttatatcttttcttgagagggtaagataatcttacttagtataaataattatcttatttagtacaaataataatctagcttggtccaaatatatgaggatagttactcgaagcttaaatttggacatccttttgttgggaggaagagctagaggagggggcaaattataaggttatgtactacctaccaaaagagtatgtatttttgtggagactccatagtagtcaatttcatgggccaaactcttccttcaaaagatattaatatgatgttgtgatgttgcatatgtgatgatatttctctcttctactaggcaattaatgcataaaaatataaaactaaaggatagtatatgtcgtggtatagaaagaaaggcatcattaatcctgattgtgagtcaaggagaactttagcttatatagaaaaggaccatcttttccatatgaagtactttttaaaagataaaattatgaagtccatagactagagtggacaatatttcacgtgctgcaccataaaccctcgactgcaacggtatataaaataggcaatcacttttttagacatacaaaacaaaaaaaaaattctttgtagatatttgaattgcattttcctaaatcataataaaaataatttaattagttattatatgaagttctattccaaggacagatagataagcatattttagtacaaaaatagtcagagatttgtttgattcttaaacacaaatagttgaagatttgtttgattctcaaacacaaataacaaattgtatgtctcctcagaatatcttataagactctaccaagcttcgagatcatgccagattatctttaaaaatagccccgtcctactcccaagtgcgaattttgctaaataaatatcatgacctatacaagaaggatgatggaatgtttatagtgacaggataacaccaggaagtgccacagctatcgtctattaattcttgatgctagctagtcttgcactggcatggcatgacatgatccgaccgtcctttcttctgccgtacgaaccatttcttgacgcatcataagaaaaagcttagggagtgcatgtatatacatatggagcaacatttagcatttatcacccatgatgcaagcatggagatccccatgatgggacggctcacatccacatctactcccgggcatttaactccaccaccccatccaatgcttccctccgttttgtctcccccgccccgtactactcggtccacgcctaacaccaaaaagtaaatggtaaatccccatcaaatcccctgccttttttttttattcgcacgtgaagtcgagaacaaacatcaaatcaatagatgaagcgtacagttacttcgatcgccgtaaacttttgtctcctcctcgaaccacgtcattcccatccttcaaaaaaactgccacgtggcaaaagtctacaaatttataatattataaatatataaatattatgactacataaatatatgtatatatgcagcacgaatcacgaggtaagggacgattggttggtgctgacattgacgtgtctctattttttttttgcccctcttcacggaagtcgatgcttgaagtcaacctgatgaccggacgctggcccaggagggcgtgtgggtcgccttacccaagggtcagcttaaggatgggtcacctcgaagggacgaatctgtttcctctctctcatatattataacactttttctctcactatttctttggctctgaggcctcagccttcttttccgtgtccccccgtcgtacgctctgcactcgcgagaagcacgcgatcctcgctatgactttttgtacaaccttttgattcgaggaaaattttaaaaaaaagattataaatacaggtactaatgtttttgtttaaattggaacgcactcattcgcaaagtaggggagagttccacggagagaaggctcgtttatggaaaatatctgattcggccgaccggcggttttcatagacgacaatacaccaccactaccctctctgccaggctggagaggggtgtgtttacctacccttgctgtctggtgaaattgatacatggaggagactttcataggagtggattttattttatttttactttttacatatatatatataatttataagaaaatctaatattatgtttattttcaaatataaaaataaattgaaatgtaaatcgaaatagaatgacaatggaatgtggtgaattggagccgcgatttccattcaattgtttggacgtggaaaaaaatgtatgaaaaagaaataacaattggattccaatatataatttaattaattatatatttagtttatattaatttttcaaatatatttaactttttattttatattttattaattatttattatttactatattacataccttatgttgcggtcaatcccctgtagcgcctgtcgctggtgaagagcacctgcaaaatgaagtccatactaatcgaaattgtatccgacagagatcctctgatgctcaaataagtagagagtggtgaatagcagataagagtatttgaaatgacaaagtgttagctcaaaattatcttatcaatactgttcgtttacctccattttatagataattcagatataaccatcgagcatgtgatcccactttttattaggctataatcatagagttaatgggcggtttatgcctattgatagtcgtgacacgtagtcgatgaccattcataacggttaaacatgtgagttccgcatattcggacattatgtgatcatgaggtgccattgatcatgttctagcattatgtactggcagttcagataaaccgagtatatatcggtaatagtagtaggtcgacagtcgtggagttccgaatgagcgtcgatcgataattttgatatatcaatgatcatcagtcggatattcactgagtcatcgtggttgtccgtcgatggttgagaatagccgactgtcggttggtcaactgattgttagtcggagtattgtgttcataaggacgatgtagaatcagagtcgaggatcggttaaattatcccaatagttgccctccactcctaagtccaaggtggtctgacgtgtatattatcacgtggtctgtcacgttggacgaaaggagttgtcacgtgctgtctcgagccccgactcgactgctggtattaatgattttttgcaatatgagagatcttcagctattttgctgtttcgatagctgtgaaatcatcattgggctgtcgttttgataagataattcgacgcccaagacatctggatgatttgattctgtctagtagatattggccacatgtccaaacatcattggctctgagctgttcatgcagataacggtaaggtggcatgatctgggaatgaatgcatcgaatcatccgaccaatggtcggtcttgatgttgccacgtgtcgatatctgaggagatccaggtttgatcgattttatccagaccgttgaggggtcctatatatatacatagttattttcatccaggctttactttgcatttgttaacatcctcttcaacagaaggttctgctggaaggtcgccccagtactaggagctccagggtattatttctcgcaccatcctttgacttcaagttgagttttcctgtcttcctctttaggtttttctcccctagaggtttttgttttctctttttagttctccatttttcatggctagtagaaaagcttcttcttctcgggatagttgatcggagaatccaaccaacgactctccttcggatccagaaatgaaagcttcttctttatccgaacacaatgttgactggctttgggagcagtaccgtatcccggagcagtatcagctttctgctcctaattcggatggtcggatgaatttttctcctctgggtctggtcgtaatttaatcgaggaccttcgggtcgatcttcgatttttgattctggagttcatccgaaatcttcttgattattatggtctctgtcctgctcagttggccctgaattctatccggctaatcatcagcttcatcctattgtgtcagcttataccgactgttcctcgtccttctctttttcgatctttcttagtccttcatcgtcatccgaaggtcaaagattgatgattcttcaacttgagaaaaggcctatcttttatcatcgatctttcatcgtctattcatggatggaagaatcaatttttttttatttcttctttttctccttgagatttttcttcatgctggagtgatccaaggactggccctaacgagaacagtcggatggaggccaatgatcgaaaagattttctccgactgaaggatatggcagttttaccgcagtgagagctgatgaccgaataagctctctacaatgccggacttagttcggtcacttctttaggtataatatagtcggttactttatctttcatgtctgtttctaaactttatatcaatctttttgttttgattgcagctatgcagccaagagatgagtatcgaccgctgatatccgctcgcacgtatgctaccaagaaaaaggcagcagctgaagctggaccctctcgatcgtcgaataagggtcggatttctactccatcagtattggcgagggaatccgacattccatcagagatggttcctgagccaatcttgatgttgtcagccctgacaatgcttcctgaggtaccatctgttgaagatgggacagcaggagaggacggggttgcagcagtatcaatgacggctccatcagtagaggttcggattagggcgggagttgcaaccgaatctgagcagtctacagctgcgccagccgttcctccagcagaacattctcgagcgcagtcgagctccaactttccaacattctcaagcgttgaactgtcgatcgaagatcgagggaaggcgccagtgactttagccgatgacgggtcatctgctagccttcaaactcttttcgacattcggatctctaagggtgagtcagccttggccaatccgacattggccaagcggcttatcgaagctgctcttctcctgactaatcgggagaatagaaagaaccagactatcgttgaaatattttcttcctttcattcgatgatattcggggtaaattttctgacatctcttttttttatttgatctgacttgatttatcttctgctttcagtgagtgcatgacatgcacgatctaaaaagcgattatcggaagattatcgattttcgtcggtcgtggatggataaggtggtggccgtcaccatcgaaaagaatactgccgtcgaacaactctaagcagtaactaaatgggagaaagaacttcaagagcaaatctcctgaatgacggtcaatctacagtcctctaaggccgaacttgaatcggcatgccagaacatctcatccctcgagtctcagatcaggagcaagaagcactccatccattggctccgacgagagagggatggatgcattgatgaacttgaagctgaacacgtaaggcatcgggccatcctgaaaaggctggcactggccaatgctgagttggcctccgcacgaactgaagtaaagtcggtgaagaacgctctaagtctagccgtcgagaacttcaagaattttaaaaaaatcaagaaagaaattctcgaagacggatatgcttcctactgcgtcgggtatgaggacgatcgagatgcaatcgaaaaattatatccggacctagacttgagcagcatcattcctcctggctcgggagatgaagctgctgaagaaggggctacaccgactgaagacgacgcaccgactgcaccagaagctgctccaatcgtcgatgttgcaccggagcaaggagatgaagacaacgactggtgacaggtgtagcatttttattttttttttgtaattgaaagaattttgtaatcgaattttagtctaatttttgtgacttccttttcaataagtgaaagaattttttcaagtataatttttttttctatgtacttgcaatatcgtagaatcgtagtttgactatcgaatatcgatcgataagttgaatgttcgatagtaattgtagaattattcgttagtcgaatatcaattgacatactttttaggtattaggataaacggtgatcagccgaatatccttcgaccgatcatagtcaagtcagtatatctaattatttgataaacgatagtaagccgaatatccttcgaccaatcgtagtcaactcggtatagtttcaatttgatctggatcgtattgccatagtatttcacttagttaaaactaagtcggcataaatagttgttcaattagagtcgacttttacagtagaaaattgagatatagtcggtactgagatacagtcggtatattgatttttataataaaaattgagatatagtcgatgtattgatttttacagtgaaaaattaaaatatagtcgataagaattgaccatccatttatcagtctaatattactttgtagttggccaaaatttttgtgattatgaaattcaatgtttcattctgaatactgtacatatgaacaactttattaataatataactttaaatcgtcagcattccacatccgtggaataattgttccctcaagagtttccagccgatatgcatccgatctaagtatctcggttattttgtaggatcctttccaattcggagataattttttctgatctagaggtcttaaaacttttatttttcttaggaccaaatctcctggatagaagatcttcgggtttaacttttgcattatagtaccgagctactctttaccgatatactgccatccgaccttgagcttgttgtcgaacttctggaagtaagtctagattgaccctccaacattctgaattgctcgactcactatattatttcatcattactgatggtaatccgatctcaaatgggatcatcacttttattctataagccagattgaatggcgatttttccattggtatgcgaggagttgttcgatatacccataagaccggatataattctttcatccagaggtctttagcttcattcagtctgattttgagtccatacaagattattcggtttgtcactttcacttcaccgttggattgtggatggccgattgatatgagtttgtgcgtaatgtaaaaatttgcatagaactctttgaagttctgattgtcgaattatcgatcattgtcggtgatgctggtatgtggtagatcgaatttgcatatgattgatttctgaatgaagtcttccatctttnnnnnnnnnnnnnnnnnnnnatatcgagtttgtgcgtaatgtaaaaatttgcatagaactctttgaagttctgattgtcgaattatcgatcattgtcggtgatgctggtatgtggtagatcgaatttgcatatgattgatttctgaatgaagtcttccatcttactttctgtgatttatatcagaggtccgacttctatccatttgttaaagtaatcaatgacaaccactataaattttctctgatcagacgtcggaggaaaagaatcaagtatatctattcttcattgtgcaaaggaccatggcccaacaattgacgtcagctgactagtcgattgatgctgtatatttacatatttttggcatggttcacatcgttggacaagttcaactgcatcttttttcatagtgggccaatagtatttttgtcgtaagactttataaaccagagatttgcccctcaagtgatttccacaaatttcttcatgaacatctctgagtgcatagtcaacgtctgttggtcccaaatactttactaaggaaagagagaatgatctcttgtaaagttagccattcatcaaaatatattgcgaggccatccatatgagtcatttagcttctaagggattcgtaggtagagttccatcagtcaagtactgaatgatcggatccatccagtttggttcatcattgatttatagcacttcttcgactttatcaatactcagctgttcaaggtattcgacaaatgtccgacccagcgagttgaatgaaattattgcaagtctgaaaagtgcatcggctcgagcattttttattcttaggatgtgaaagatttcaaaatattttagaatcaacgtaagatcttttaccttctaaagatacttcatcataataggatctcggacttcaaactcgtccttaacttgcccagcaatcaactgtgagtccgtgaaaatcttcaggctgtcaatgtcaagctctttgacaatctttaagccgactgagagtgcttcatattcgactttattattcgaagctttgaaattgaatcgaaggacatattcagttacaactccttcagaattgatgaggatgagaccagctctactgtcttgtgtattaaatgctccatcaatatgtagcacctatgctgacgttaagtcagactcgagagttgtaacttactttattttatcgttaactttatcctcaagattattatcaggtattgtacactcgacgacaaagtcagccaaaacttgtgccttcatcgatggacggaagcgatattgtatatcaaatttgttgagctttattatccactttatcatttgatctaaagtgtcagatcgatgtaaaattaccttcaacgattgatctgtcaagatgacaataggatgtgcttggaagtatggacgaagccgttgtgatgatatgattagagcgtagatcattttcttcgctcttgaatatcttacttcgacattatgaagcaccttgttagtgtaatagataggtcgttgaattcaattttcatcctcttatccgctcttttctgtttcttaagcagaaagtcaaaggttcgacctctttccgatgtgctaatctgttatgatcaatctcctatagcgtccgtcatcggtgaagagcacctgcaaaatgaagtccacactgaccaaaattgtatccagtggggaccctccgatgcttaagtcaatgaggagtgatgaacagcagataagaatatttgaaatggcagagtgttagctcagaattatcttaccaatgtcgttcgtttacctttctttaatagataattcagatataaccgtcaaatacatggtctcactttttattaaattataatcatggagttaatggatggtttatacctattgatggtcgtgacatgtagtcgataaccattcataacggttaaatatgtgggttccgcatattctggcattatatgatcatggggtgcaattgatcacgttctagcattctgtgctggcagtttcagataaaccgactatatgtcggtaataatagtaggtcggtagtcgtggagttccgaatgagcatcagtcgataactctgatatgctgatggtgatcaatcggatatttactgagtcgacgtggttgtccgtcgatggttgaaaataaccgactgtcagtcggtcaactgattgttagtcggagtattgtattcataaggccgatggagagtcggagttggagatcgattgaattatcccaacgtcttaaatttaaaattactatttcaaattttaagattaatttttttatatttttatatttataatttttaaatgtttagtcatatttatattttgtttattaatttatattaattttttatatttatttaatatatttttactttttatgttcaatattatctaataatttatatttatatctttatttttttctttaacttgcattatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctttctccttgtttagctattctacatttggtttctctttacttggtatgtaatcgagatattcgtttctctttacttagtatgtaatcgagatattccttcttcttgtaattgctacaataggtagaccttgtaatctatatatactcctattggagaacaatgaaatgcaagaatcagaaattatcctcaataaagatattaccttctttatgcattatacaatgctcatttattagtttatgatacagagtaaaactttttaagtactggttgataaaatattacaaggtgtgctccttgatatctttatttactaaaataatacattaaattaaatgtttaataaattatttattttcatttgatatcataatcatagataattaattcacatcaaaacatgctatttcctaccatttgataccataaaattattggttggttcattatcaaaaatatcaccaattcctattttcatgagaataaccattccttctatgtataagtaaaattcccctttcatcaagtgaaagaatagtgatttaaaagaaaatatggttttgtcctttattgtcatatcaaatgcttgaacaaggccaaagttagaatctccattccattacaatacgcatttcagggaaccaaatgtggtgcagagagttagaacctaagattttttaaagatctaaccttggaccataactaaccagaagtttccaaattattttagatagaatctgggtccagtgcaagtaggtgttaatttttattagttccagtgctgatcctcacaaacactaaaaattgatctctttcattagcccttgactatgattaaagatacccattatcatcacgctttaatgatttgaccatgccaaacatttggaaaaacacatcctagttcgaacctagaatgacttcaaaatggagggggtgtaattatagagttacagcctagtttgcatcaagcgcatgtgttggatggtcatcattaacacaaatatcatattgtgatacttccactaggatggagaaaattgaatcattgcatttcacgccacacaatgtacatatattatctatcaagatggacattttataggttaaaattgtacataattaagttggtggcattattctcacactatttcaagctagctagaatcaaaattccaacattacttataccacttagtcaatcaaaacctcaacttatcatcatgttgaaagagtttagtttcactgtgagaaaaataattttcccattatgagttttgttgtggcaaatagtatttgcctctaaaaacaattttcatatataatcgagaaaataattgcccttattgtatgatatggtgaacaaaaaaaaaacttttaaaagtatctatttacaaagactaacttttttttgcctctatagtttttttaaatatataaatacaaatattaattattgctaaaattttaaccatggtggctataaatatttaaagacaatttcatgaattttagcagctttttttttgtgctttagcatacgttgttgtaatgtttgcatcaagaatgagggtgcctaattcttatgtgaacatgaaattttctatcaaaagtattgggacaatacaaccgacccctgactctaactctacatcggtcgaatgagcatacgacaccgacttacaattggttgactgatcgagaatcggttattactgaccaacaactgatgactcaataaatcgtcgaccgaagaccatcgacatatcagagttaccagccgatgcacatgcggatcttttaccgacttatcagtattaccgatatatagtcggtttatctgttcaacacatcctaaccattgtgaacgattatcaactacgtgtcacggtatttagtgaaaattaacgacccactaactccacaataatggtccgataatttagtgccataaaaagcgggaccacgtgctcgacgattatatcagaattatctataaaagggagtaaatgagtagcaccggataaggataatttctgggtcaagactctgctacttattttatctactgttcaccaactcctctctgattttggcatcggaggattttcgtcggacacaacttcgatctgtgaggacttgattttgcaggtgctcttcatcagcgacaggcgctaaggagttggacgcaacaaaaagtatgatggagatcacataggaagcttaggtgaaaaaatagtaattatttaatttaattttgttgggcatgaatgtgaagctttacacttcaagtggtaggacatgtactgcactcttgaaggctcatgtaaaaggaattaattacgagcttggccacttaattataattccatggtacagtactgcacggcgcgaagtccgtcgaagggtcgccatttgatgtgccatcctaattaaccccatgggtctaaaatatagagggatccacccgtagccgatgcctcctcatttgatgcctcttccatgtcctcctcttaaatccggtctggtgaaaaggtcgttattatggtcattactattttcttttatgtcggggtgggaatggaggtgttatgagttgtggctatcattgcattgaatgcagagggatctaataagatggtgagaggatcatacaatatgtgcatttaatgtcatacatgtatttaaacctaggttcatttaagtttcaattttaattgtccactgaagagtggggttggggaagagagagagggagagagagagagactctgaataataccattctgtctcagctagcccaagggccactcatttattgagatgatgaaagaatcatgtaaattgcacaacttgtacgtaagagttatagttgaatagatcagtccccaccccccaaacaaacacacacacatataaagactactgttgtaatgaaaataactaatattattagtcaaaaattggacttttaacatggttattgcagctctccaccaatggagaattttacaagtttaaatcaataaagatgttctcacaataatttgacccgagaaatttacaacacttagttaaaatgattgtggtagccctacctttgttctcaaaaagaacatataacttaaaataattgtgtttgttattatgcaactatttcaagaacaaaattttggttttgttgagaaagataaaatttgattttggaattatcatggaatcaaaatttataataatatttaactatatggatagttactatccatattatataataaataatataatttggcatgtgcaatgcatgcagaatctgtggatgattgtaatcctttaatttgattaaagttatttatgtggataattgcaactcaattttagaaggcccaaaatgaaaaatgaatgatgtgggctgtactatctcaggaatttttacatgcatacccctacaatgtggtttgtttatatgtaaccttcaaaaatctgtatttgcatatatagctcttgatttattctatttttgcagtgttgcctatcatgttacaatgttgattgttagcatcaatatgtatccattttaagtatatataagatgattctattatactttgttttagtatacattttttataaaaaaatccacttttaatttgtattgtggagagctatgttttgcataaactttttaggaaaaaaagcaaataggataatagagtcactttatatatacaaagtagctacttattgtcactaatagctgaagaatttacaagcatgctagccactgctgatggactaaaatgatgagtatatatgcaaaagtaatttttgccgaagcatttaccataagtcatattactagagacatatatgcagaaaaatccagtatttaaagtatggagaagtattaaagaagtgtgaaagctgatagtcacacgttatgaagcctcatgaacacttaaaatatgggataattagaggagacagattttttgaatattttgtgccgatacactcacatgtaaagttgtaaactagatgatctgatgcattcaaatgtacagtgaaatatctattttaccctccatataacatgaatacaaatgccagtgggctacataaagattaaagagcatattaaaacgtttgagtatcctgactgaattgacttagcttgaaatgaaattgttataacattcgttgctctaattattataacactctctattctaatttacaggtacctaattgctaaaacaaaagcaaaacaagaattggttcaaataactgccacaaacacttcttgaatgttggctacaatggagaacaatgattcaagaaaggagtaagagaacggcatgagttgcttattctcaatggtaagctggtgcttgtggaaagaacaaaaccaatgaatcatccactttgaagccattacatcaaaaactactagcagaaaaagctgtatctctattactagattggtcatctgtgccactgcaaggagaagcagctgaagatagataaagcttgtgctacaacacaaaaccatcagctcactggggaagtgctgtgcagaagcaaacatttgacttggtgtatgatgggactagacgcccaccagctccaaaccctctaattacaagcttcgaaccctcttaacttcttatgtaatgagatggtttgtaaacaggttgtccgcatacctggtaacaccatccccttgtacacaatctcctttgaataataaatctggagtaatcacctaatcatatactaaaaaaaaaaaaaagaaaaaaaagagtgaattgataagtctatataaaaatttgctaaaattatttcaagatatgctaaatattcttaatcttatattatttatctcaatgaagcatcttactaattctcaaaatctaatcctaacaaacctaattcattttttagataacctaatttggctcggattattcaaaccacaagccatggatgtagaacaagtgagttatggttcaaactgctctctacttagtttttttttaattaaaaaggaaaataaaatatatttgtgtataaatatataacttccattttagcatctcttctatggagaagctcaaattgaatggatagaatagatgaaccaactaccaaacttctttttcattgcttccattgtcaaacgttggacggtgtcaaggaagcagtcaagcaatcactaaacccaatcctatattactttaaaatttggctttgccgcctaaccccaagcccaatcgtataatacattggattaaattttgggacccaaagaatcccaatacctccctaggtttagttttcagacccaaaccctatagtttgggtttgcttgagattggtttagcaatttattgccccatcttgctgtgtccaaatttgataaatagactcctaattgtataaagtgcatttttttcttatttcttccttcaaaacaaaaatgaatcaaggagtatatatatttgactttttttaatatacctttgaaaataactatggcacatataaccctcgtcataaccttttttgttaaaattcatttttcttgttcaatagcattgcctctcatgttatgatttcagcttttggtgtcaattagtagttattttaagtgtcaaatgagtttattatccttttttgatccataatatacctagaaatttccaatctttaattcatattacatagagattgttttgaataagcttttttgggtactgatgcaataagataagagtcattttatatttaaaataaatgcttactagcattgcttggcaaaaatttaacaaatgagattgtgctgatagggtgaaaatgagaaatttatgcacaaataatgattttccctaagtttggaatcagccatattgctaaaataaatttgctaaggaacaacatcattttaaaatggacgtattatagcattgcaaaggtcgacaaccatgtgtaaattgagtcatctagatggttttctttgcttttcttttttttccatattgtgtgctaaaacactcacatggaaagtttaaaccaggtgctgtttaattgaccctgggatgctttgtttttttttttgaaggatgaaatttctattttgccctccatacctaccttcatgttgctttccaattatttgaagattttaacagcaaaagggtatcattttcattaattggataacatgtataacatgattgttcatgttgatgggctaaatgaaaagcatattcaaaaatttgactagtggtggctgaatgattcagtttgaaatggtataaaaataaccaaattagggcattaacattcctagagctatcgaaggactccaatactatcataacatttgttattttgagatgcaaatgcctaattgtgaaatgtggttcaaaataaactagcttggaacataggtgtattaatataaaaagacaagtaagctagtaatattgtatcaaaattcatttagattctttgtacatatatgtaatagtcttaatcattcctcttctttttctatcatttagaatatttctatactaataatctcaatcaaacaagttattttgtttgtaatattattataattcatgccaaattataatactaaaatttatatttaaaaataaaaaaatttataggaacatcttttctactttagtccaattttacttacactcttatattttaaaaagtgtcaaactagcctttttagttattgatatatttcaatatggtccagctattcattttattaataaacggtgttagatttctctcaatggacaaaaatatcctttattcatgaatggacttggaggaggaagaagatgggaagaaaaatgggatgaggaagaaggagagaaggaaaaaatggtcatgggtaaagaatggattagaggagaagaagaaggataagaagaagaagagggtggagaggaagaagaggaaaagaatgggttatcgatggaaaagggtggaggtggaaggggccgccatgaagggaagggcttatgggcggtttgaaggaaaaggaggatgaggaggtgaaatggataaggaagaaaaggaggtggagagagccatcatgaaaaaaaaatgagtgagaaagaaggagagaaaaaagattttttttgccagtaagaagagacggatgtagaatgagccatctaaagggatagggctcatggattggtttggaggagaaagggaatgagaagaaaggggaggaggggagaagggctacaggcaaagaatagggtggaggaggatgaaggggaggagaagaggatggggacgtagaagatggggaaggtaaaaatggatgaagctatggaagaggctgccataaagaggaatagtttgtggatggcttggagaaaaaagatgaggaagagaagtgtacaggaaggagaggagaaaagggaggaggagaatgggtagagaaagtggagaagaaaggaaaggaggagcatgggtgaagaaagggaaggagaagaaatgagggagacagaggaggaatgggagaaggggaaatgaatgagaagaagaagatgaggaaagaaggagaaagagagacaccagctatgaaagagatgatcagttgaagaggagggaggaggaaagagatgtgttttagaaaagtttattaatgaaaatagactgttggataatgttggaacatatcaataattagaaatgtcagtttgatacattttaaaatacagaaaatgtaagtgaaattgaattaaaattaagaagatatttttataatttttttataaaaataaattagtatcttctaatcttattggagctaattgatccgtaaagaaaaaaaaaaaaaggggtaacgttctgaggaccatggatgaagggattgaaagggtcagatcagttattgttaacggccgttacttcagattatgggtttagaatggggtgaagcgtcaaatcatcgagacctggtcaagcgagtatgcgaccacccaactcctccttccgggatcccaccccgcccacacccccacaatcccatttattcccttctctctacccatctccatttattatatcacacttactctctccctccctcctatttttcgccgccccatctccccctaccatctttcggtgcttcgcctccgcttatctctctccttgctccccctcttctctctccctctctcgacaactcccctcccttgcgctggctttggctttaatccaatcaaatcaagtccagccctcactcacgcggagataaaaaaagagggagacgaaaaggaggcgcagtgaagagcggagggcgggatccggccaaacaagaaggaataaaaaggtaccttctctctttttaacggcgccgtcgcggtcgcggtcgccgtcggatcggataaccgccctttccctcttttctctttctttcttttccaaccaccgactcgaagaaagcgatgagttagagcagagaatggtagatatttatttacatcactcattgttatgaaatttttttcattaataaattacttgcaagggatcaacgcgtgccagtcctggttgctcgctcttaacttcaataaaataaaataagctgcagaaagatctcccgaggatatcagaggaagaagagaagagaacaacgccgaactccttcgttattctcgacttatactttccaattataagatccgtaaccggtttttattttctttcattttttattttttacagttggatcgcgggatttgtcggcaaagcaaatccgacaacaaatcccacgatccaaatctttttctttttattcccctttcctgtaatccgaaatagagaggatatagaaagtacgcgaagggatatacgctcatgatcacgtatcttttcaccaaacctttcttgtctcttcattccatctttataccaatttcctttctctcttttgtcctgttaatatgtctccatgtatccataatctaatcaaaatatctcaaagctaagagaacaaaatctctactcacttcccgtctcaaaattttttctttttttgagaacttttcctcagaattattcaagggaagaggattcttactgcgatggcgtcgtcgtcagcgccggtcccggcctcatcggccgcggtgtcgtcatcgatgaccgcatcgacgagctcgccatgcgcggcgtgcaagttcctccgccggaagtgccagccggactgcgtcttcgcgccctacttcccgccggaccagccgcagaaattcgtgcacgtgcaccgggtcttcggcgcgagcaacgtcaccaagctgctcaacgagctgcacccctaccagcgggaggacgccgtcaactccctcgcctacgaggccgacatgcgcctccgggaccccgtctatggctgcgtcggcgtcatctccatcctccagcaccagctccgccagctccagatggacctctcctgcgccaagtccgagctctccaagtaccagtccgccgccgccgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccgactcagctccagcaccagctccgccagctccagatggacctctcctgcgccaagtccgagctctccaagtaccagtccgccgccgccgccgccgccgccgccggcggcgggtcttctgcccccactttcggcggcgggctggccaccgccggcgtgcacggcttccttaatgccgatcatccgatcgggttcggaagggagcagttcttcccggcgggaaataaccgggagccacctcgtcccaaccagcacttgatgatgaggaattttgaaggggagttggtggggagattgggtgcgaatggagcatatgatgcagcaggaattgtggcagctatgaatgcgtcggcggcgagcatcgggccattgggtgggcagttcctgaagccaagttctgccggcaggaatgaccggccgagcgtcgggccgtcgtagatgtccttgcaggtttctatatattttgctactattattttctgggtgcttcctcctctttgataacactatgcttttatttgattttagtgtcaagggtggttcttctacattagtagtcaaaagtaagagcttgagattagctgcatgatatcgcaaaagtcatatatgtaaaagtagtcaaactattgatatatatatatatatatatatataatttcctaggtaagtaaggagttggtaggctcctaggcaatatttatagtgatgagatgatataaatatatgtaatgtttgtttcatagctaagaaaagaacggagccgaattttagcagttaattgttgcaaattttgtgacaaatcacttctctggctttaatattagttggtggtttcggttaagaaggtcaaatactttgggagtagtgtgggcatgcactgttctacgtaattatcaaaaacctggtataatacagtctggtagaaaaatcccttaaatctgcatcgagtaactcgtacaacattgagcgagttcatgcagattatttatccatttagtgctttaaatttgatatatctgccagttatccttgaatggttatgctttaaggcatgaaggtcattttggatgacatggttagccgattctagtgccccatagagatggagagttctgtggttcaaactccttaattttgaagaataatagcatgatgaaattttagtgtcccatggaagaataatagcatgatgaaattttagttaagactttgaagaatccttaatttgctgcagtaaaagaaaagaaaatctgaatcataaagctattgcttggagaagttcggagcaaattatgctgctgcctaactttgaataatggcattcacacgaccagatagcataactgtgtgttgaagcaaggagtttaaggtggattggccttcaacatagagaacgtttcagaatcaaaggctgaacaaatggccgcgggatagcttttgtaataataatttacatcaaaaaaaagtttttgttataataaaatatatattgcattttaagttaattggtgtctatttctagctgttttccaaatagatattatgctccaaagagaagctcgttattttgatgtatatttcttgatcacttcaatttgaataaacctccagaacttccacgatcttacttcttttcaccaaaaaagggagagaaatgtttcttttaaaatataatgaaaattctactgtaaaaaatcttctagcttcttgtttctttcagaatgaagacaaatttcttatggctttggcatgtggtgcatatgagtacatgccatgcctgcccgcatctattgtgctgttggcatcaaagtttttgattgcaaactccatcaggttacactgttcgatcacagtttcattaacagaaactagcgttagaaaaatccttcaagaaaagccgcttctatagttaacattgtttggattgggttcagaaaatctaaaacttaagtatattgttgagttgcaggtataaggcttggaggatattgggcacttgcggatgaaactgagagctagagagttagaattgacaaagacgcctggattttaatttcaatccatttacatgaaatagatttttcttttctcccccttgttttatcttagcgttgtttattttatcctctcttcttgatctggccagttggacattttgtattccgagtgcttgttatagtggcagtcctagttgctgtatccccccttcgttacctgcatggcttatttgatcttcctcacccttttctgttgtaatgatttttattacctgttaacagaattttggaagttattttcaaattgttcgagatgccaagaagaaagaagaattgttttttgtggggaaaaaaatccttccactttggcccaaattttactatttgctcataatgtcttaactgtagaagggacccacttggatccattgttttggaatcatatccaccaatttaatgcattgttatggtggattcgatttcttctttcctcttgcatcttataagaaattgcagatctgttgggatatttgggtgctacttccatgattaataaaccactcatggaatgtttatcacttaaaaagatttccatacaaacgtactttatgggcagggatgactgaaatctttgatagggtccaagtgctgacaataaaattataaacatccatcatacgatacctttctttcggtagatatcagttttctcatcattatcaaaccttacataaggctctgtacccataaaattctgatggtcatcacaagatattgtcttgatgcctgtcaataagaagggtaggtctcatgacaaccatcatatggttaagtcaatatcatatggtcaaggtcaaggaatgtttatcacacaacaagatttccatacaaaataaattctatgggcaagggtgcatggttgggaaatctttaatagggtcaaagtgctgataatagaattatgaacatccatcatatgatacctttccttcggtagatatcagttttcccatcactatcaaaccttaaatagttctatgcccatgaaattctgatggccatcagaagatattgtattgctgcttgtcagcaagaaagataggcctcatgaccaccctcatatggttaggtcaactacattccatattggtggtcaatttccaaagacaaaggtacatggagtggatatattgacagattcaatggtgatgtagactcagaagcatttgagggaagcccaaaaggttagtatggtgagttaaagctgaaacatttatgggaagcccaagagggttttatacctattcctctgagtcttcaagtaagactgtaagaggttggtggttgaccagagtctacaagacttttcctttctctattgtctaaaccctccattgtgaatgagtctctctcgactttgcggagtgatagaaaaatgacagaaatagggagattagttagggatttgaggtggcagaaagcatttatcagagaagagcaaaagacaaatcaacaaagacaaaaggcctttctttgagagagagagagagggagccatcaatacaaggtgtcatgaaagccttcccaaaatgccgttctgatgcaaacttaatgccctaaagcatttataccgtcaccaatccccaccacctattaaaaaaatccaaaaaaaaatgccgacttgagagagagaacccttcttgctccctgcctctctagagttgtgcagacattcaaaacatagtcaaaacatacatgccatgacattgctgatgtacctaagcaatgatgaacgcatccttaaatgcatgccctttgctcacgtctcctgcgccagcacaccgtaccagacgcagatggatcccactaaaaaccacacgggcgacatacatgaaaatattttgcaaaaaacaaaaatgaagcattacaactctatggctgtgcttagattggtccactgccgatgggtctgatccaaccaataatctctctctctatatatatatactcatccatccatccatctttatatccatgcatagtacctgctatcctcatgctcttgttccgaactcttcacttggaactcatgaatcaaataggctgagcttaaaccacatatagtaaagatgttagagatttttttatgcgcccattgctcacaatgataattcatttttcttctacacgtaatgctatgttcacagcatttttttacaagactttggttatgcatatgttgactgcagtatgtttagcaacaatacaaaaaaggaataagttttactctccttgggaattgaggaagtcaaattgaatagctaatgttccgtacttgcattaaagaattatgctagagcggcaatccacaaaggcatcacccttttgactcatactatgtgctctcgatctgtacaacaaaaaaagcgcatctcgtatagttttgctagtcttgccagtgatgctctccatcaaaagtcacgagctaaagttggagtgccatagtgccaagactttgttcatttcaatgcttatgctactgctgagacgtgactcagataacttggctcggtgagtaggcaattatgaagtaatgttggattcattaatcttgttctgaattttctcccttgctaatttatcttccaaaattttcatggcttctcacgtttcctccatgtttagctgtaagtttatgaataattcatttatcaacgaaaagtgcggcggatcatccgctgttttgaacaaaacaaagaaacctttcagtatcataaattttaatttatggatttatagtggaactaagattcatgcaacatgttatacattagtagctttggccggattacccaagaaagccccattgcgataggagatcatgatatcaaatattttccccctttcataacttaataagaaataatactagaattttaaattttaaccttctttttgaaaaatatgagagttatggatccaaacaaaaaccaagctgaccaactgtagctttttcatggtttcagtttacgtggcaccttcgtacgttgcatcattgagttggacatatacatatgtgcatccaaaaaaaagttggtgaactgtgtgctacatgaaaagagctgacttatgctaagaaaatttgagagcttcccacgttcatttagaggaaaatttcttgatagctattaggtggctttcagtttcactgtttggaggtgtcaaacttcagtccctcgtacagaattaccagcgaatggtgcacttccgactttcttttgggatgacacatgttggagtattattataattatatatatttagaaggatatatatacatatataatccattttgtatccgtctaatgcaacgtatctataggagcatgatgcatcaaacctagtttatcacacacacacaacaaaaaaaaaaaagtgctgaaccgaaacaacccttcggctccatccacatggagagaagagtagggtccgagtccaagccgtcccttcttcacccaggaggcatctaatcaggcacatcaacgtacggccctgattggagggccaccatgaacagccacgtgcatgggtagccccaacgcccattaatggaagaaacaaagagagagaagcacgggttcaaagtttcaaacgcacccgcacggttcccgcggcctgggctttgttttggagttggggagtatatatcaatatacgtgaggtgatgtttgaaaaggacggtttagagggtcgggggatattccgacacccccacgcgctcggttacatgtgtaggtggcaaaagagaggcgtttaaagccttgacacagaaggaagaaggaagagctgtccatcatgtaacaccaattttaacttttaaagagagagaataaagaaatggactctgatccctacaaagagaacaatttaagtgtctataggagggaacagagatatgtacatagatagctgtgatcaatacttttttaaatataagagagagtgagagagaggagagatggcggggtagttataaaggatgggagaggatgtatttaatggtggggatggtggcatttatgggacagcgccaagaccatgggccttatttgactgttccttctcggagtctggccagttgcacgcttttccagtaatagaggagtgagaggaggaggaagggaacgatgagcaaaataaagaagagaataccaccacaccccgtatcatgctccttaaaaacatgctttctgtctcctgcccattaaagacatttaaggctgagagaggaggagagaagcgaggcctctagctcatgcatgtggtgggcctccttatttataccagttcccacgcaaccttgaagtcaaggggctctaattgtaggaaatctctatgcgaccttggaaataaatgaataaagatacgggttgatgctaacaccttgaagagagggctgggagagggactaagcttggtttcagcctcaagataatgaccacatggaccaaaatccttatattgagtctgtgtgatgcgtgtgttttgatgtttgtacatgtatccattgatgtggagaggtggttgaaggagacttcaaatattgcaatgcactcttttggaaaatgtaattggatgaattaaggattgagagctgagaacaggaatttagcacttccaccaacctgaacattttccttaccctggcaaagctcgatggaattgtatttgtatcgggaagtgcaaccatgagcccttcaaaagtgcatcctgttcttcgaaagcaaatacatctctcaaatttgaacacgttggatctatctagagatttcaagtgagtcttggagaccaagatacttgtgtttcaagggaaaaataaaattgtggctagggcatgtggaattcaccaaccttgaggattggtggaaggactccaaggtaaaggttaattctccatctttgaggaatattattctaaatatagttctcaaagtagatggcatgtcaaaactcttaaagtggcgcaatttttttcctatacttatagcatttgagtaccaaataacttagctatgctctacctatatttttgctctattctccgatggattgtggtctggacgcaaacaatgcattggctcttgggaaaggattagactctggttattttaaaagccacatgcaattgttccgttgtgctgaatgcagaagagagccctcatagaagcatcttggtcccaaatattaagaacctgctgtaaatggatttatatgcactctacttagaaactttatatagtagccgatagtatgtagaaaggctcgatcacccacggaataagatcaattggcctaagctcaccatgaacaagcaccaataacaattgagagaaggatttgtgagaaaaataaaattttaaaaaaaagacaaatttggagagacaataaataatttttattaataatcaaattttcaaaagttgaaccaacattcttgcttctactataagaacattttacaaaattttatatcaaaaagtgcacacctgaagaatcaaattatcttattgcaaagtccatgctaacgactttatggaagtaactcctcaccgagcagtagctcctcattagggatggcaaaatcgatccgaccagatggatatgcaccatatccagatccgatcaaatccaaaaaataagatttgatcggatttgggtaaaacccaaaaactgtagtacgggtataggtaggatatgagtagtgctattttctatccaaattcgaatccgaacctgatccgaacctacggatatgggtaatatccgaatccatatccaaatatatatgtttataattttattttggtaattctattttgattgataatatgcataaaattattttggttgtttatatattctatgttgaattataattctatttctatatttgatttctataaatttgaacttataaattatgttctatgttgaatttgtaattctattttgattgataatatgcataaaattattttggttgtttatttttttggttatgagataggtatgggttgggtatggagaaatgggttatccgtgggtatcctctaactcattgagtatggagatgggtatctcttttcttatccgatcagatataaggtagaatttgggtatagagtattaagtttgggtttgaagatggatagtacaatatccgatccaaaccctatccgttgccatccttactcctcattgacccattgtgaggacctatatcgatatgtatttagtctcacatcaattatttgataggaagatctaggttacttatacagaactgaataatctaaataatatttttcggctagtctttttggataagatcctggattattattaatagaatcaaagggatccggctcataagtcatctggaatgggagatattatagcacggattcattgagctagcttaaatgataagagtacgtgaggatccatgcgggtaggggtggaaccaagccgggcgctacccctatccaagcctagttcaaaaataattttcaggcttcaagccgagctaactcctaataaatgtgtaaaaatccaggcccgagcacaggttcgaatccatttgggttagctcgagacattacttagttcaagcctagctcgagctcaacccaatattaatataatgtgagggtggtggttcaatgattcacattatcgatcatattgatttgaatataagttttcttcatgcttaaacctcttatcatcttttctgttattgaactttcctattttaattctatcttaccttatgctttaggctcggagtgtgccttgttcgagacccgtgggctccgatgaggagagaccgtcggaattctcggggccgttggacgaggcctcaggccactctttctgctacatgtgctctgccatacctgcccactcctgctcatccttcgctgccaccaccaccaagaccaccttcacgatcatctccggtgcctccatctctgccaactcctccatccccctctcaatctatgatgccccgttgttgtcgccgcctagtcataggctattggcttccgaagctctagatccttctcaaccatcctcctttagctttcagtggtgggggtttcgcatcggggctagttaatagagatttgttcctcttcgggccgattaagtagtgtgcgctctggagcctattcgatgccgtacctttctttagcatgctcatgaagaagaagagccgggatattttgaggaggctttgaaagctatccctcttctactagagcctctcggagaaaaaccgccaccttagatgttccccctctggagcttcactgtctgatggagcaaactcgacgacgtgccccctccagaagaaacaaagaagagaagaagaatgtgcgaacagcggtgctgcaattgaaaaattaaatgagaagattggaatcgaaagagttagaagagtgattttgagtttggagtctccgagcctaacttaagtcaaatggctaagcttagccaacttttatacatttagatattggggcctaagttttgtgttaggatcgcacttgcagtcgagcttaggttggggcaatggtaggcccgagcccaatccaaaaatgaaatgggctccatttctaaacccaaatccggtctaattttgttcggatctagcccaacctacagtcgagcctatccgagtacattttcagcctcacatgcgggtgtatatttagtctcacatcagttatttgctggaaagattttaaatatttatatagaatcgagaaattcaaataatatcttgtgactaatctttttggatggagttctacgttgttacacccatcctctccaatgaatgctgaaatcgatgacctccacactctattctatagccaatcaataataaattgtttggcatcattgttcttatgtttttttctttcaacaaattaatcaaataccatatggagattgatgttaagtatagcatttgcactattttcactctcttttggaagctcaaaaattttacaaacaatttcaagaaaaaagaaaggttccaccatacgtattgtttagtttagttcatttttcatcatgaattttaaaaattgataacaagaatgatatcaagagggcccttgtgcggttaaagcaagccactgagtctagattagcagctcctaaaaagttttatcgatcattcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactaaaaacttaaaaacttaaactaactaactactagagacaaacaactactactctctctctctctctctctctctctctctctgtgtttgaatgcaaatacatatacatacaacacacaaatagacacatgcatgcatagagaaaaaaaaataaaaacatataaaacccataaaacaatagccaaattcctactcagaaaccaccacctagatgtcacccagctgcttagaaaggcccccaaaagggtagtctcctgcacattctaaggcccaattcctgcctaagtgaccgcacacaacaatgttactaaagcactaacattcatgatttgccatatcaccctaaaccatctgatatgggatgtatcgagccaaacctacaaggaacaggatggttccccctgttggttcaatacagagcccgagccctccccggctcaattaaaaatccctcacccagctctattccctcaaccaactcagttaagcacccccttcccctcaaccaccgaccacttgcaaacaccatcccaatgctactagtgaatgctgcccctacaaccgcttatgacagccaagagtggtaaatccctccctctctctctccctcacacacactcacttgctcacgcagattcatgttagggttccctcccccctcccccctccctcttcctcctcctcacaccctctctctctcgccctccttttctccctccccgcctccctctccggctctccctatttcagtataccctggaatggcatggtatgaacctgtactatgccgaactggtcaccggccaatatgcccagtggtgcccattcggcaaaccatgttcgcatctacaccatcaatatttagagcatccaaacatctcacaaataaaatatgatgtaggcctacatgtagcatacttttaaacagttcaacagaaaataattgaatgagttagggcccaacatctcatcagctgcttaggcccccaaaatctgggtggtgtaggtgcttatgccatggtgatctaggcaaaggtcgcctaggcattctaacgtccatttaccgactaagtgaccacctgcaacaacaattgcaactaaatcaccaacaccaccaccacatagagattgagcatcacatccaaacatctcactgataaaatatcatgtaggcttggatacagaaaactttctaaacagttaaacagaaaacgattgaatgagttaggacccaacatctcatcaatttctaaagcatctgatcaacaaatacagcaattttcctaacctaaatcatcctaaaaacctaaaagtagtaatagatgaatcaacacactagctgcctaagctgagctgactgtccaaaatgaaaattaaaaaaaaaaaaaaaactaggacaatgattcatcaaaaattaaatatcagggaaatattttccctgattttttttgaaggaaaataattacaacttgctaatccattaacgcaaagatcaattaattaacttttttttctttttaggggtcgagaggaggtctagatggtttacatagactggatgcagtacagcaaatatcatccattaacttagaattatcatactggttaaaataggctgatatctagaatatcattgaaccttagccaggcaatgttccataattgtaaggaacaaaagattccttggtatgaatgacaaaaaatgactattatgaatgtgttaaaaagatgaaaggcagcaagaatgatgaggaagtaccatgcatttagatagtatacgaactcgaagcccacttctccaatttctctcatcaataagctctgtgacctgtaacccagtaataaatggagccttcagccaaagaagttcaaagcgtgcacatgaaatggaaaccacgtttgagatagaagttcagaacatacagctttctcagcatcctcgacagtctcatactccacaaatgcatgcagctgcatgtaaaatttaaaaatatatataccaacatgtgaatgaaccagtaaattggaaaaaaaaaattcatgtaaaatcatacatggattatatgttgatacatattttgattcagacctaattttgatcaagaaccgatctaaaatctgaaagccaaaacaacaaaagaacatacatctgaagaatggaaaaaactgaagaggggtttggttacaatatctatttatgcaagtatttgcacacataaaaaaataaaaaataaataaaaagaccattctttatttgtgctaaaaaagaacaagctcatttgcaaatttacttcatgattttttgatggattgataatagtttgccataaatctttcagagtttcatataaattggcaactacagacaaattaatgcactcatcactaatttccaaatgtgtgattactgaaaattaaagcatgctccatgttcacttgtatgcacacacagggatcatagcaaagtaaacaatagaaaatactatgccactaagttcagcatctttaagaaaggaacagaaagcatcccatcccttctttcttcgaaagatcttgggttcttacatttcccttttatcttctctccaactcatgatcatcaatgctgttgttgtcatcagcaagaatcctcctcctctccccccacctccacccaatccctccctcccaccctcctctcacgaggctaggcaggatcaatgacattttagagatcagactggcaaagcacatctatatggtcaaaatgcttgcggcagaagaacggaaagacgtctttgggtgggtttgggccacggttttgaacctaatggaacaggactaacctgaaaaataagcccatttattaaaaggataggtctcggcttggggattaaagcttggcccagcccaaaattttttaactctagatttttatgattaaatttaaattttgttgatatctaatttaataggagaagatccagattcttagagtagttattaagcattgaaattgctgttaaaaatacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgcaggccaggccgagctcacgcctaagcaaattgtgttaattattgggcaaagcccagccagtccaatgaacccatcttgtttggaccacttaaggagagaggacagagattagggagatggaggacaaagccttgatattggattcatgaagctccaccatggcaaggagagagagaaaaggtgtgtgctgagattaaaggcattctggtaaaaggggaaggggagagaagatcaagcggtggatgggatcaagatgaggtgagagagctggtattgtcatcactcagtaatcatcagtgaccacaacaacagcgagttcaagtagttgcctgtgcaaagcaatatggcgtggaaaatgggaacagaacaatgaaccacgaaaagcctgctagacatttccatttcttttaaaaaaatagctgacgtggcaacaccacctcagcatgccacatcagtaagttaagtcatatttaatagatctgcatgtaagagtatcactattcttaaaagattatagagtttcctgatatctcatttaattcaatcacaacttaggccatgcttggttcccaagtaaacctaaataaagctgaacaatataacaacttttcggctataaagctgaacaaaatcaccactttttcagctttattcaggttactcagccgaacaattttttctcctcttgaataaagccccagtaatgagagaacttttgggtttaacccggttaaaactattaaggaggaagcactgaatagttttatctgaataaaattattaacatatcaaggtaaaaattagacggaaaccacatacagccttaatcataaaaatctaccaacatagcagattttactctgaaaagttcacaggtggttccacttcatcataagaatcatgtaacattttaaagtagtaaatggttattatgagacaaaaaaaaaaaaatgccatttgacaaacagaagatgtaccttgttatagaaaagcatttccagttttgatgatctattaactgcagcagttgtgccatgggggttgccattaggattctgaggatagcaggtacgaattgttttcacactacaatagataagtttacaacataaatgaccaagattttcgtgacttggaaaaaattgacttctatatgacataaagctccttacctcccgacagctgaaaaaaccttcataaggttttggtagcaatgatcctcgggtagattttcagcaacaacgatacgtgactgtaaaggcaaaaaaaaaaggtatcacaaagaatatatataaataaattaagaactgatgacgggagtgatcgaataaaacctgcaattcttcaacatctccctcagtgaagggatgcaagcgtctaactttctttccatcatcactaacaacctataaaatgcaaaaggcatggtgtatcagaagagagtgtgcaagaagcattagcatataaatgtatcagtgacactagtgccagcaactagcaaactgctgtagaacttttctatatgaaagttacaagggattttgaatgaggaacaaaatgcaacatgcaaccagttatggaaagcagttgttgggaaggcatatgatcaaaatgaaggcattagatccaattgagaatctcactgaaaaagacttacgagttttgatgatgtctgtaacgcagcagcaagcaatgaattgttatggactaaggccttgatcttcttaaaagatgcaattactgatattggcactgcatcaacaacaaggatgtaataattataacaatgtcaactacgttgctacttttaaatctgatgttgattttatgtattagatcatgtgcaccaaactgcagaacaaaaggatgttcataaatacatcttgtaaggcacaattgctgcaggaacaaccacataataagagaaagaatagttttgcttgtctaattggctctgaccagtaattttttttttttaagaaaatagaggggatgagtggccccctaattgctctgaccattataatatgcattatttatcaccttccaccacaataatcatttggaatacatttaacaccagatatcaatgattccttctcagtacttaacaagcatggacaatttaagatacaacaaataaatggcccacaagggcttatcatcttcttgcagaatcacatgtatataactccttgcagttgacagttaaaagcaaataaggtggcaatttggtcaataaagtttcacccttattttcaattacccattgcttttctctacctagctttttagcccacatctgcattaaaagaaatgaactcaggattgcaaaatctcatgtcaacttcttcgagttatggagggaattcatcttttataccataaaactcttttttgctagtctcctttctctatcatacaaagtaaatcattggtagatggctgtattattcttttttcttcaccacatctcaatgattatggcaacatattgtattgaacagccaaaagataagaaactgatttaccacaaagtctactggaacataaccaccataaacagtgaatatgcaatagaattatttcattacctttcttccatatctcaaaaattcgatgtatatatatctaacagccccccacccaaaaaagggggaaagaaaactccacctccacctaccaaagccagtttacacctaatccatttgatgctatataactggattgtctattccaatgatactacattatttctcccttagcattgtcactcctagtgaaggtgcatttacaaggtacatggcgacaacacctatttaaaagattccataagcatgaatagttataaatcatactgttgaatgtagcggatcactaagtgtagtcacattgcaatggatcgtcattaagatgttaagagcatgcacaatcttgacagaacatgtgatcaaggactcatttatggtagcctaagagctgtgattgatagactattaagtcatttagggcagtttacactttttcaaaaattgataaaagacaatggttaaaagatggattaagttttacatttaatttacacccagcttatgagtcaacagtcttgtaacgcaatgacatgtacataacatcttgcattacatagtcagaactcaaaagcaaacaattaaaaagaaatgaacacaacattgataaaacagatgtccaccccttaaataacaacaaaggaaactcatttccatgcacaagaatccagaagtcttttccacccatcttcttcctctaagttgatcattggtactaagtaataatgctttataggtttctctgcaataagatttagattcgcattatatatttttttaacttacatcagagatgcttcacttcataatcacattactccagggtactcaccttgacaagtcttatgaaacatttgtgaccaccagtcaactcttttatgagctttataagctaatttggaatttggaaatcccttgatgatatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccatctcattgaactctctccacccccttctcaaatctctcatctcccatctttctttttcttatccctaaagttccaatgaaaaaagagagaaagaaggaaaatcccctttcctccatggtaccatccttctttgctcggttcttcttctccactcgtctcccatcatctcctcccaacacctctcactaagccagcaccaatttcattgtcttctcctcccatctcaaccttcatatcctcaaataatgattcttctcagtaagaagaaaagaagaagagaaactgaaagataatcagagaagaaaaaagaaaaataagattagagaaaaaataattattattttgccagatcaataattttttaaaattttaatgccacataagtaccatataagcatcaatggttgtcacatcagactttcaatgaaagaaagccatcagaatagcatatgaaggcaatattaaaataattttagatagttcaaggactaaactttagctttttataatttagagattttttaagaatatccaacattgttcgaggatcagaaatgtaattgatcccaaaaaaattttgattcagaaaatctagaaattagagacttctaatatgtttatatttatattcaaaaaaaaaaaaaacccacactaactaccatggatagtcaaaaatattagactgattataagatttggttgattatttctcttgtgatgattggaaggcttaaatttggccacttgtttatttatataagcggtcatgtattggtagtttgccattaacttaactttatactggaacttatcaaaatgtaaggcagtcatttgcaaaaagaaccatttgaaagggagttatttatgtaataaaccactagaagccactatggtcgcttccaatcttctcttaggattttaagatccaaagtctttcttggcaataaatgatcttccatcaatcaatgaatgcaacacagtttctaccaaagaagcgaatattcaatctacatttttacatcggcattgagtcatccagagcaaaggctcaacctaattttgcatgaatgttgaagaactcattgtttgtgggttcaaatgtttgcatgccttaccaaaaaaaaaagaaacatgtttgcatgtagaggttgagtaatgaaggatcaactttgttgcacatagagtttaagtgacttgtgaatttggtcgtggactaaaatgattcgagtctcacataaaagcaaaaaaatcaatttactccttttatatgggatcaagtagtagaattggccatgtttggagcagcagagatgatttatttctccttttattgcttgcacttatatatccttatgaaatcaatttcattagtttgtttcacttacgtgtgagttattactttcctttttggctttactattgaatgaaattctcatcctattagaacttgtgaaagccctcttgctaaggtatggccaaatcttgtctcttgacttaatcgaactctttagtcaaaagcctcaatctggaattccaacaacctgatgtgtcaaagttcagtttccatgatatagtctataaactagtcctccatctcatgtaatctattggaagattttagtaacaacaaaacttctatttttgtaatggctagtatgggtctttatgtaatagaagcttaatgttaaccattatcatattttataaaattaatagagtgactgcttaggtaaaaataagaaaagaaaatgcctgttggactcaagaatcatgccttcttgaaagaactatggtggcctaatgttctacaagcattcactagcagaatagagcaacttttttagagatattaattagagtgaaccaagttaacgagaatgtggaccttatttagcattacttgttaagttacatgctcttattcatctcttgataaggtcattaatgctcaccgggtgactaatcttggcaattcaataggccacttagccaagccataacttaaaataatcatatcttttatttgatgcaaaacctacggcaatggaagaattgattctatttctgtaacgcataagtagttctgctcaatgtgcatcacatccaagtatatatcacaagtatatggattcttttgaattatttattttttactattttccttgaaaagaacttttttttgcaatgttcttagtttatacatacacctaagattcatgtaacaaattatttgtatggttgattccaaaaaaaggatatcaagctaagtttgctttattatatagaatggaaaatattctttactttttataatggtgaagcaatttcaaccatcagatttattggatgagcattcaattcaaaagaagttgttattgtttagggcaacgacaaataataaaccatgcgatacccaagcattttgaccaaaaggacatcgatatgccagtcagcatctctctattcagtaaatgcgttgtgaaaaggttttatgttccaattagaaagtgatagtttcacctttcaggctttgatatcatgttaagcaactaattgacccaaagtttaacaagtagtactcttcaacaatctattaactagattaaccatcaatttgggtgcctaacatcttataaattttccatcatgataattgtttattttggtaatatagctataatacatttatctgttatattatttttttaaaaaaaaaggtaaaaccaacctactttgttaatttgagatctctctcccggcattaagaaaaattattacatcatcaactcatgtagtgtgtgtgtaaagtacttatgtatatacacatataaaatatacaacaagagttgcataatttgttccttgcatagtggtacttaagaaaaatgagggaaaaaaaaagaatagagttggtgaattaaagtgctctcttcagtttgagaaaagagcaaaactccattctattcttcttttcatattagcattcaacacagaatttataattttgatatgttagattacaatagaaagaattcaaagaaattcaaatgtttgtaactatcctttcatgtgggctaggcataatctcttacctggtcactcctgtattaggtaagctgaatggcccacatcaaactaactcatatcaagagtatctacttgatgatttttttaagaattttctttataaagttggttatttgaatgaggtgaataatttttagagtcatctcaatctatttccttgctagtgcttgtacttttatacttttcacatgacatcagaatatattcatcaaagcttatattccacttagcattgccagtgccaatcttgttgtgtaattttgcaaaagtccatagaagtttgaaggtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcatgaacaggcctatgaaaataccactattgtttacaaagtaacaagcaaaaatgcttgattattatgattttacaaccatgactaagaaggattttgttaggtggctcattagatcagctggttttgtgaaggtatatttggtatttatgctaccatttcaaactaacagtgtgtgtgtgcatgcttgtattatacgtatccaatagttgcatgttactcaaaattatatgaagaacgcacgtgttatctatcttgcatattatttatggctcacccgagtctcaaaccggcctattagctcagttggttagagcgtcgtgctaataacgcgaaggtcgcaggttcgagacctgcatgggccaagtcgtaatttcataaagaaaatttgtaagttttttttaagtttttttttcttaaaaaaatccaagtcccttgcattctgttgaaaaaattcataatcattttcttttaagttttattgaaatattacataatccctttataacctcctgaatgttcttaaaaatataataaaaaaagatcattcataaatttttttccaaaaaattcatatttccttataaattgttaaaaaaatcatcatctcttgcattctgttctgaaatttctccatgttttatgtaatcccttctgtaacctgttgaataacagacttttcctccagcatcctgagtagcattttcatatctcgcaatggctgtgtccaagtaatttcgatgtagccgtcagcaaagtccaatttaccttagattgatggcttggaagccggtggcccaggtagttcaatgccactctcaaattgatggaatttctggacgagagcccttggactgcctagcctaggccatagcagattcaatcttaaagacctaaaaaggtttgacttcgcgcagaaaagatttcacagtccttttgttttatacgattcataatcccttgcgttttgttttaaaaattttgtaatcccttctcaccgtattcaattttagggcttgttcgggaaagataggattggcccaaatcttataaaatatgaggaggcatttttaaaccaaatccgttgaaaaatccaaacatacccttgagaacatgtttggatatctaagatttttaaacctaagataaaaatcatgatatgatataggatttaatcctataggattatacaaaaaattctattgagaaaaaaaaattcatgtaaataatcctgttctatgtttgactgataaattatgattttttcctcctccctccttcttcttcccaattcctttaagaaaataagaaaccataatagtaaacagaagaaaactgacatgatagtaaacctcttcagtgcatatcagaagtctgaattcaggatgttgttgaagcaaaacaaagagcaatacaaaaattacatgtaaaatagatatatagaagcattgaaaatagtgtattttctcataatgcaagcaacaattataagcatatcatacatggtaccctgtaaaagatgagacatcataatgatagagcaagataattagtggaaccaagctccaatttgaattataggccggcatgggcagtttaatgctatggagtatttccaatcagaatttttaaaacttgaaacatcatctgaaaattttaaactgagcaacagcatattaaataaactcaaggtaatgaattctttggctacaggtaaagagccattgctcttgttgagtctctgcccttcagttcaggttaaaattgaattatcatatgggccaatagaaaagcagggatatactatcttcaagagacaatagcataaattttttagcaacttaaagtccaaagcagaagacacatgaaacatcttaagagtataggggcctaagaatacagctagtagtataatgcatctataggcacatcatagaaattcagaaaggatcagcgagacaactaagtagtagattgtgataggttgtagaatagatgatgcagctatacaatcatggcaaaaggctaatctccaaaagagaaaatttagttctgtcagatggtgagtataaaccaaattacccatcgaaaagtcagaaattaaaccattatagttgctggtgtgaatcccatcagaatctttatcataggaatcattatatttaatatttaccatcttcactttagcataacatcaaacagttgatgagcaaaatttataggatatccaacatagaagagagtggagggcctcttcgatctgaaataagacattgaatcatcggttttcaaggaattgtgtcagctagagttgccgtagcagcgatggggtcaaaaaggccaccaaaggcaagcacaataaaagagcatggcggcagtgacagcgaggaggagggcagtaagatatagacagcgtgggaggaggtggcgagagggtagagaagtgagaggaggaggagggagagggtgcgcatgagaagaatgacagaaaaggagaaaagaatgtcatgtttagaagagaacatgagaggaacgaggaggaaagcccggcgatctcaggaaaaaaaatagatccatagagatgattatttttttcattgggattagccacttccaatagatttttaatctcatgattaatctagctaaataatagttagaatataaaataaaatttttatctctgagattctcaaattttataggatttgagccaatcctattcttcccaaactggctccaaaaagctcaaaaggcttggcctgctacaattttccccaggagattggaactttcctccaagaagccatttggctgtgcacatattatctacatctggaggctgtcaaataagttcaccatgagtagcttctcggtggatagttgtaggttgctttttttggttctattgcaaaactaatcacaataaaaattccaccaccagggcatgcagcggcggatctaaaaattttattttataagattaatataataaaaaaatagacaaattatgaagaaagaaaaaaaaataataaaatattattttttaaatttattattatttttaaaaaaataataatatataatatcttaaatattttttataataaaaaataaattaatgtgatctttttaggatataaaaaataaattgatgtaagatttaaatataagaggtggacggatgggattgggatggaatattaaaagataaataaaaaaataattaataaagaaagagaaaaagagagagagaaagggagagatatcaaaatggtatgagagaaggagagaggaaaagagaggtaagacatgtgaatcatcaaagaaagaaaatattggtcataattactcctttgatgtagtatttcttatcttttatttcttcaaaattttatatgagatatgaagtcaattataaaattaatttatttttttaatattatggggccaattttgatttttatttttatgttgtggggtcaatttttatttttttattatttttttaataataatttaatatataaatatatggattaatttttttatgggatcaattgatcctatatttttttctcttgcacccacagttgagtgcacgtgtgatcattggttgcactctatcttcgtgctaaatacttactcgcatcgctttgataccatgactcccactccctttatcctcctagagcttgccccacctctactagtgtaatataataatgcgaagatcatgctaatataggataatacatcatttgatccatataattcattaattatatcataatatattcatagtctaacaaaatatattatatataatttatataatataaataaataatcaatggattttagtatcctcgccaccatcatcgatttgaaaatcactgaaccattaatagccattgatctcgacagtctcgactgcgaacttgaaggcgccgagagagcctcgaacaaaatgatgctgttggaggaagctagtaaagaacaacgaatgcatgcctctctacccgtccaatcccatcacaccttccatccaaagattttttatcaatttatggttaattttaaaaaaattattaaaataatatcgagctcaaactatttacgaaaataatgctcagaaaaaaatcatcccttcacaagatgattttctttgccaactcaccaacctgaccgcctgctggaggccagatggataagagaaataagtcacctttgataaggcgactttataagttgccctttgacagggcgactctcccgtttcttcttttcttctttattttaagttaatatcttcatttattttactttttattaattttaaaatataaatataaataaataaatatttttttatttaaaatcaataaaaatattaaaaaattaaaatttttaaaaataagaagtcaaaacttgaattttagttcaatttttttttcaaatccgaaatttttaaaacttttcttcttcaaaacgaataagttaaagaattcaaaaatttattaaaaattattttatgatttactaatatctaaatattaattattattaattttgattttaaaaaaatatattttatataattttttatatagatgttagtttttttatttaaaaaatttttaacattcgtgtaatcacagcatctgaatgattttaataaatttaaataaaataaatttaatttaaaatataatatactgcacgtcatcacttattacaatcagattcagccgttataattatatagaaaaagtcagacggatctttcaagctcccagccagaggttggtttcacctagcttggaagtttcctgggttgcttgcagaagcaagctggcacccagccagcctctccagcatctggtcattgcgagccaatagttgctcgccacctatccgttccatacccccctctatctcttttcttattggtaaaattttgttccggtctctttcggggccccaccccaccccgtcccgttctacctctacaaaactttggtctctcgcggcctcaccaccatctctcccccactggccctctccttcctcagcccaccttccgtcctccctaattttctcttcattccagccccatggtccacaaccctggggcagcccgccggggccgggatccgaacctcatcatagtcggcacatttgccgtcttcgtcgccgccggcggtttcattctcgcaaccacaccactggatcttatgggccgccacctgcacttgtcgatggagacgcacctcgtgatcaattttgtcaccttcactcttgccctcctcctggtatacctttggatggtcggtgctgctacaagggcaccgtcaccgctaatctccagaaacgtagccaaatctttggtctctgtcaccctcaccgtgtcgctgacagcgctatttttcggccatataaagagagagaattttcttaggtcatataaaggtggtgcgagcagggagaatttaccgcgttttcgtacgtacttggggaataattgcatgaaaagggggcgtatttcggaaactttttttttttttccagcatctctaaatttgtttgtttttcttcaattagaatattttttagttgtcacgtcctcctgaccgccaccatctaagcataatatttggggcctctttgctaacaaaaatttttattccggattctctctattctctttcgaaaacccacaaatagccgcagatgagagagttgcgtgtgcctcggtgagttgcctctatcgcctctttgatcgcatacgtcttcgatctgctccaaggcccaaatcccttcttatttaaacttataacatttttttgacggtgttacgcccacctgtggtgggatctgtaattaaaaaaaaagaaaaagaaaataaaggaatactgttattagaataaagcattggaatgacatgattatatcgtagaaataaaatgctaaatcctgtacaaataagtacacagtttattgtttctgaaagagcaatcttagtggattagtagtagagctagcatcaaacaatcaaacaaaacttttgccattacaatagttgggtgcaggcatccagataaaaaagaagtgttcccacaatcacaggcaaactaagaagatacccacaaatgcaactgcagcatttccgttttcaactgcaaattttatcgcaagcaagcgaagccgcacacaaccaagcaaccctcaatccaatttctattttcaactgcaaattttattggaagtaagtgaagctgcacgcaaccaagcaaaccctcaatccaaatagctttctagccgttcatgcccatgacaaatgctcaaatatatggtggtggtggagaagaatttggcgtcatgcatgtgatggctcctcctctcatccagcagcgaacctttgcacatcatcactcaaaaaaatatttatggctttgaaggagttggagaagagggtggtttcaagtcggggtactgcattcacaaattaagtaggtcataagcaaatgcatcagttatttgtatgataagactccgtgactggctaactaggttttaggatttgggtcagggctcagggggctccttcaagaggaagaaaggtttacaagcacttccttcaagtactccatctatgtgaatgcatctagtattaattcacaaacatggatatatatttgaagcatttttatgtatttaatggaacccagaacaaaaagttcaatggtaagaagcagaagttgagaatcatacatttgggtatggtgacaaaggtctctcaggagcaagttttgcttctgaagcagtttccacagagtctatgtgatcatttcctgtattctggttcttgtcctgatgaatgcttgaagaggccagtgcccaaccattctcattgttctgctcatctgtcctttgactgttaacaccagagggatttgttgctttgctcttctttcttgggtaaacatgcacggatggtggaagcaaggtttcttgaatagcctacacaaaataacaacatcattattgctgccattttccttcattattaacattacaaagtaacagaagagtaacctgccatccatccttccctctgagtccacctttgattgcatatgcctctttgaaaccattcttgaacaaaagttcagccacttttaaggaattgccatcaaagctatcttacacaaaagaaacgatactcagcaacaggactgcaaaccacgcatgtagtcatggtgccatgtttgtcatggcatttggtggtgcatgaagcgagttttacatctaaacttctaaaatgaaaaattaaaagttcaaattcaaactcttcatcttctggtcaaattatctaaagaaaaaatagaaagaacttctaagtgtgtcaatcttaaccttttccatcaaaagcacttcttaattgtatctatgataaatgaagcaagaacaagggaagaatgaatgcaaataaacatagaccaattcaaagttcctttttcttttatcagatggtctgataacaagaaaggttgaaatataaatctgattcagcatgatgagatcatgaacaatggagaagatatttcataacttgttacaaaggattaaaagcatgaagattcatgcatgcatcatatggtcataaagcagcaatagaaaaggatgtaaaagaaagtttaggcaagatatggcaaattagattcaaggaactactagcaccataaaattgtggaatactgtaaagagacaaagattgagattaatggactttggcagtgtgtcaggaagctcaactattgagctcagtgaaattaataaaggcacgattgtgaattaattccaagatcattcaagatatatgtggcagagtaaaaagcacatggtaatggctagaacagtgactttccatatctagcagtcgaataacaacaatcagctgagttttcatcactatgctcttcttgtacaaaacttgtccaccggtattcaaaactaaaccatgtctaaccaggagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctgactgaagcatcggaaggtctccatcggacaccatttcagtctgtgtaaatgctgttttgcaggtgctcgttaccgatgacagaggacggggagttagctgcaacagattactattggtaaatagcggacgacttgagctgatggtatgacaaaattatcaaccgacggccacgcctactaccgacgtatggtcggttgatctgctcaacatgccataccgtcacgaatggttatcgaccgcatatcacggtgcaattagtgaaaattaatgacccactacgtgattatggtccgataatttagcgtcataaaacacgggaccacgtccgacggttacaagaacctcatctataaaaaagaagtaagtgaacaacaccgataagccacttttgatcagagctctgctacactgaatattcaacaactactgttcaccaacttttctctctgacttaagcatcgaaggatccccgccggacaccattccggtctgtgtggatgctgttttgcgggtgctcgttaccggcgacaggcgacggagagttggccgcaacagattgacgcgccaggtaggggttgaggtccacctcggttccttggggctgaagtccgcctcggctgactgtgggcctcctcggactgtacacatcggagttctccttgactgaggggctctgttgtggttttaataatatggagggcactaatagtctcacatcggttgtgagtcaaggaagactcgcgcttataaggagaaaaaaattcttcccacatgaggtaccttttaaaggacaaaaccgtgagactcatgggtcagagtggacaatacctcacatgacggatcgagcctttgtccgcaacaatggcgcgccacattgattgtgagtcaagagagactcgcacttataaggaggaaaaaatccttcctacgtgaggtgtcttttaaaggacaaaaccgtgaggctctaaatgatcaaggtccgttgaaacctaaaggcctactgaagcctaaagatggtcatgaatcaaaacggacaatacctcacgtatgcggaggcgaagacataagccaaccatctgagccattaaccccttaacccataaccacaataaatccaataggaccagggagagtatgtgaaataaaattttagagggcatatagaattaaagcaatactggttgaatagattccaaacagaaccataatatgaccttatcacattaacttgggtttacagtggaagagaatggagagatggtgaatacacttctatcagagcaaggaataaatgaggtacatttgagtgtcatatgctccctggtcatttatatcccaatgatatgatatgggaataatgtgcaggaataatggtaggcatataaaaaggtccaagatccaaatgcataacatagaggtgagtatgttaagatagaagcattgaaaaaaatagtaaaatagaataagcaagcatcgcatatcacataaaagaaacacaagaatttatatcagtatagtataaagttcaaccaatgatatatgggcatatttaaccaagatttcttgtaccggtaccggtggccggatcgatcggccggtggtacgatacggcacgcctccgttccgttccgaaccgagacgaactgacgaaggaaaccaaaaaaggaaaagagagaaagagagagaaataaagagagagagggaaggagaaagaaaaagagggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttctctctcttcctctctttttcttcccgacaacagcatgtaccgttttgcatgccggaaccgtctcggttccccgccgggacgattcggcacgccccataccaggcggttcggcccggtatggcaaaccctgtataatttaacaataatcggaggagacccaagtctgaagagagaatagcaccgtgtcgaaacatcaacaaagtaggaagaatatcacaacctacatgatagtaatgagaaagaatccggagaaaacctaatttgaaaatatagcagtagttcataagcaaatataaaatggtcttgtaaagccaaccccaaatatatgggatagcaattgctgatttattggttgaccatatcgaaccaagaatgttccaaaaataaaatttgaacatggatctcagaacatggttctggtgaccctggagctgatgcaaaaaatctgactcagtttattcataacatggctgtgagaggtagggaatgatagaccaaatgccccaaccaaacatctatttatatcaaaagcaggacctcaactaaatctgatttatcagtgagacaaggtatggtctccttcataaggaaaaccaaaatcctatcaaatgaagatcatttcacataaaaataagcaatatgaagaatgtacttagattcatccattatataaataccaaactacaagaattttcacaaatctgtttatttcatccctagagaataataaaagggggaaaaaaatcaatggctaggtacataattttagtgatttcaagtataatcaaagtataacacaaattctttaaagatcccatacagctgacacaccaactttacgaacatttattcctcaataaaatgcacaaattacaaacacagctctcctacgtaacaagcttaaaaacaagcagattttgacacattaatcaaacctcatgaagccgcaagaactatatgtttccattcatcttttttcctcctattttctcagcacattaatcctgaaagcaagtctagaaatcctagaattccaagttctgtattcttgtccgaacacattcatgctcgcataaaataaaaaaaactaccatggcaaatatgaaaaggtcagagaatatatcaatgctcacttgtcaagaacacaaataatggtattcccaggatccctaaacttcttcacaacctctttcacgaagccctcttcttccccttcagcgaactccacctgaaccacatccttatcaaaaatcttcaaattgggtgaacttatgaactgaacgctctgcttattcctaatatccagcagctgtgaattgggcacatcccttagcttccgaaaagcatcaatggcgctgatgtacttgtacttctttagatacccttgggtcagcggtattacgaccagccaaatgaacgtgactccggcgacgaagaatgggttccggttgaagaaatcatcgatcgagataacaattgcttcgatattgatcttatctgaagcagaaagctctgtttcggcggcaaaggaagggaatgggaaagaaacggcagccatgatagcaagagagtggtgaaatttccaaggattgttcatgaacaccgagtcctgaagaggaatttggagatggtaaggtaaaattttcgagaaaggtgcagtcttttgggcggaaactcggatggtgagagaatttgggaagtgggaagtatagaatttgaaaaaaggtacgatcttttgggttgggaaacatttttggtgagggtttggagcatgggaagccgagatttggagaaatggcgagggctttgggatcaaacggtggtcttggagaggaatcatgaggcaagacgagagggaaagaaagagaaaatgcggacgtggcgcgatggagcgcgtagctcgctatccataactggaatctggatcaacctttaacccaaggcggacgcttacggaatgtccgcacaaaaatttctatacgtacatatctgtcctccacataaactgtgttgcaagggtgaagtgattggttgaaataggagaactcaaaattgaaataaataaatgttacatgtgtaaaccataaacatacattacttaaccttctataaataaagaatcaatttttatatttaatgattagtaacataacttacccatagaagtattccacatgcataatctttgaactatatgaaagtcgtttattcttaaattttctaatttaaaaattaacactaatcaaaagacacatgcactgggataggttttcttatttttaggtctatttcatgtaatgattgggaggaatttctccaggttttacagtttgaatcaccagtaaaacatgagtattgatcagctctcttatgttatactgctcattgcatttggttggcttgtaattttcgcctgtttgatactccaaacatgtccccagttgtgatagcaagacatgctttcatttccaactctctagatgctcccaaagtttacttaacggtcactaggatctggttgttatagaccccttatcctctcccacttctatttgttggtgtcccctcacagccgtgcatcctaaagatctagtcttatggtgaagggcaggcagaaaatgttagtgctagctttgtcccgagagatcatcaaggaagagccattctcagggctggtcaacttcggggagcttgggaaggtgcaagtgcattctttcatttggatcatgttggtggctttcgaattgaaggtgattcttttatagaaatttcttccattaatggcaaggacaagatacatattcctcatcacccatccttgctagacatttagtctatagttcaaagggttcctaattttaaagccttgcattcacaatttgaaggaaataaggtggctgattgacttacgagaaaggcaactagtttagatgaggagttcatatggaattctagtgatgaaatgttatttgttgtatgctgatccctcgtatttaagctttttaaggggatcttaattttcagtcctcatccaggaaaaaaggggttcaaaacatgctagacttatataaaagatgttctaatgttgatagatttagaatattctcataataatcttaattttaaaaggtttaaaaaatgcccaacttctgcagaagaaaagattctaaactgtttgactttgaggataaaaggagtagagacggtaagaattgccacttcatgctgacttccaaacccacaagtggaagtttttaaaacaaaaaaaaaaggtgaaaaagaaagaaccagaaaacttctaaaaaaataccttagtctatctgaaaagatacaatagtccatctgaactctattaacttttgaggttggaggaagacttggaccaagagatgaaacttaaatataataccttagggaaaaaaaaatacacatgagttgattattctcaagtctttttagaacttatagtttagttgaattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatagttactgaagcccaatgctattgagattttgtcacttgttaggtcaatggtgcaaaataaaaactaaaggtgatgaaaagctgacttcagggtaacatgcaaagagatatgtgacgatgcaacttgtgcaaaaagttttgaaatttgaaggtaatgtgtaacaatcgatacttcaaaggtgtcagaattttggaccatccaatagctgaaaatttggtgtattctaaagtgacatagtgagggtgactgatgcataacaattaaaatgattcaaacttgtagtatttgtcaattgcaaaaagatcaccctggttagacatgcttagtttaatcatgccttcattcaacactagggcagtgagcaaagtatgtgattgctcacatacaataccttcaaatcgacagttaattcaccaagaatgatgacttcactataatcacaaattgaaagaatgcaaatgaaaattattaatgaccatgaagaattgacatgagaatcattgctgattgtcctgtatttcaaattgtcatccaactttcctgtattgcaagataaatgagcgtattgatgtttctgttcacactgaaactgaaggtttcagattaatgccaatcaaggaatttctctacacatcagggaattacgttccgacaatttatatctggagaagacaattagcctattacaatttatgaacaactatgaagagataagagatctcctgattatgtcttcattcacaggcatgattggtttatgcaccttttccaccttccaagcttctcccttccctggaaaatgattgcattagagttccagaaactacaaaaatctttcacaagattataatcttaataacgtatgcctaaacccttggaacactgctattctaaacgagggcatagttcacatgtgtacttgccaaagcaatttagagttccagcaaacaatggccctggttccaggactctaaattaccaagccactgttaccatcaaagcctgtcaatgtcaacagcagcgccaccattgtcatgggccctcagaaaatcacatacaattttaaaattctactccattcaggaaatctaagtaaaaaccaacagtcagcgaccaaaacagagtaaccttttgacgtgcacacagtcaatagaaggtttgtatctcttgccctgaaagcagtgcaagtctcaaggaccaaaattgcaacttagaggccgtctgcctactggataagagttcatattgttaacaccaaatatttgccttcaattataattctgcaattattttatatgacattgttccatctaatgctaaccagtgctggtgattaaaaagtggaccctggattctgaagtagctatcggcctgagaatggatggataggcagtctgtgcttagtcaatggatcagttgaatgtaaaatctcaatttgtgcaggcaatttctcattatttttaccattgtatcatttgacagtacaatcttgtcacttaccccatgtctcctacagtttgtgattccaccgcaatcaagaagtcatacagcaacttttaaaagtgaaagcaatacatcaaacaaaactggagtactggacaacatcttcaacttgacaagcatgaattttccccaaaaagcatagtcaagttacaaagtgcacacagcataccttgcgtgggccaactgccagctcattatctacaattgaaagagccttgaaacccacacgattcaataccttctcatagctgcaagaaagtaaaagtattggccgctgtgtcattacctcagaaatgttactacttttattttaatgcaactaagtgagggtgtaaacggataatccaaaggtgaagatacacactcagctacagtcacattgtatggtggtcctttgtcttgatcactaatctgccattaaaaaaaaaaaaattcaacaccacagtcataagatggttgatatcaggtcaagaacaaattgcaagtctgctaggcccatttatcagccttttcagcatagaattgtgctggtccatggagaaagtgatgaagataggaagagatgtgaatgatgaccgcaaaagtcatgacaataatgaccgcaacttctatttacacagaaaacaaggccacattattgagaactataagaagggctctcaccaaatatatcagtgcaataagctctccttctggttttaaaagatctctaacttttcttgcccaagctgccctcatgcatggatcaattgcacaaaagaatctgcagtaaattgcatatatgagcttcttataagaaaagatatgcaataaatggttcatgagcacaaagatgataacttacgtgtaatcaaaaataagatcaaacaactcagttggctgccaagtgaaaaatctgctaccagaaatgtgaaataatttgcatttggcaatgaggaagaccactggcattgacttgatgagcaaaacattagatagatgcttgagtaaaaacctaattttgcaagagaagctcatgtatatgtcatcattcatctcaattgtacatttctgagtagcaaacttttaaaggatcggatttactagttgagaatgttccaagaatctggttttcatctcacactaaataggtcaaatattagccactgtcaaatatggttgtcagtggttgatgacatctacctcagtaaaatcacaagaattttgtcacttaatttaaactcagaaattatgtgacagcttaccacattgagttgtcatcaactgaataaatccattatcatgtaaatatatgagcaaacaacatgaatcatattaaaggtaaaatatgaaaatggcaacaaagtaaattcatcaaacagttccaatatctatgagattttatttatgacaaagtgtattatggagcatgataggaacatgcttcaaaaggcaattaatccatgagaacttttgcttttgttttccactaaggaagcatattgtcactataaaaaaaggaagggcatatgacataagactggatggcaaaaaaagtgccataagaatctctctctttctctctcatctctgttcagcaagagagaaaagagtctttagctctactacacattaagtcccctccatcacatattaacaaagataatacatattgtgccatgaattatcttaagtcagattcatgataactaatttaggtaaatagtttgggtgtttgagtatcaagtgagaaataaggatggagagaactcaatggtaacaaaatgtaaaacatccctccaaagtcattcatagggcagtatgctgttaacagcttattacatagacagtctgcaatggaccacaacaggtctaatgtaacataaacaaaacatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatccttcaatttctctgcccaagctgacctcatgcgtggatcaattgcacaaaagaatctgcagttttacatttggtatatgagcttctttaaggggaaaaaaaaaatgcaagaagccaaccggcctcatctcagctggttggcatttctctccactcgggagtggtcaagggctgggtgctggcatcctaaaccggtttctttgaaaaaaaaaagaaaagaaaagaaagaaacaaagaaaagaaatacgcaagaactgggctatgagcgcaaagttgaaaacttactggtaatcaaatatgagatcaaacaactctgttggctaccagaaaggtgaagtaatttgcatttggcaaagagaaagaccactggcattgataaaaagataaaatttacaatatcagatcttccattgaagttatgacatagatatataggtagggtgtttcctgtgaagtatcactacgtacactaaaatcggcaacggcccaccgaatatacgataaatgtcgcactacacgtcacatgtcaaagttaataatatcaacatttgaaagggtgttttctgtaaaatgctattgctgatttcaccaaatttacatgaaacgcccgatctatgtaaatattacacattagtctgtggtacggtgagttgacctgagaatttttcataaaagtccttatatggtgtgtcaaaataactaacagtcgcatcttgctgcgactttaccatcgacccaagcagttgtttctccgttcccgcgaaaatcgaattcgaaaaaaaaatgagaatttccgagctctctccggaccgccggccgagctccgacgactcccagcccctccgcctcctcctcgaagacctcgagtcctccatccaagaagccgaatccctttccccagacgacccctcctcgggtgagaagctcgtgaccaggctccggcgttccctctcccgcctccctgccgccctccccctccctgaacccgccaagatccacatctggaagctcagctaccgcctctggaacgcttgcgtcgacctctcgaacgccgccggcttccgccccgacggccgctggaggaccggccaggccgaactccgccagatcgccgccgacctcctcctcctcgccggaaaccccgccgggatcccatccgccgccttcaaggctgcgtccttcttccacaagactggtcagatctggcacgaactcggccggttcgatctcgccgccggctgcttcgagagggccaccgatctgacctccacggtccccatcgacgggatcggcggcgaggaggagctgaggctcctcctcgatctcagtctcgcaaggtcaaggacggcgtgggaggtcgctgatcggaatctcgcgatcgctctcctcaatcggtccaaaagcctcctcttcggatcgcctgcggcattccgagccctagcggagcagtacctccagttcgggaagctcgatctcgccaagaaatcgctggaggggaattccgatgcttcgaagctgctgacggaggcgctggatctctgcgagaagggaatcgcggccgccaagggccgcggtgatggcggaaccttagatctggaggagttgaaggggcggtgcctccgattcctggcagcggagcgtctccaggtggaggactacgagggggtgctgcggtgcgttagggttctccgggtagacacggcagtgagcgccgcagcggcggagcacccgagcgtgggtttcgtggcgatgagggcgtggctggggaccgggcgggtgggggaggcggagagggagctcaaggggatgatggcgaacaaggaggtgccggagggcgtttgcgtcgccgccgctgaggcgtacctagcggtggcgggcgcggaggcggcgcggggggtgctggcgggtctggtgggacggtgccgggccggcgccggtgcggcgctccgggtggtgaagagggtggcggagggtggtgggggagggcgggcgaaggtggtggcggagctggcggcggacgagagggtggtggcgctcttcgaggacgccgcggcgacgaaggagcggaacgcgatgcacgcggtcctctggaactggtgagcttaccgcaccccttccggtatcgatgtggtcatagttaataacttccttcttcccgtatgaatgatggatacagtgcaaccgaacattttcgatcaaaggactatgacataagcgcagaaatgtttgaaaaatctatgctttacgtccctcgtgatgaggagacagagctcggcgttcaaactgcttcagggtccttagcctctgccaccttgcactcatgcagcttgatcaagctgaagaattcatcaatgaagctgataaggtatacgttttcgataaaattagcagaaaacatcaacttgaagccattactatgaattctggaactatgtctgacccttgaatcctcccttgtcctgcagcttgagccgaatgtgaagtgtgcttttcttaaggtaccatttcgttgtctcaattccatcattagtgataatattagcactgcaattattggagctttccaaattattaacaacagtttcaatgtccatatggttctctgaattattctcagtactgaatttttcaatgcatcaaaaattttatgaattacttacacttgttcgagcactcgcgaataacgatactagttagtagtggtattgtagctgttaggcatcctccttgcctctctcatgctagtgtttatccaaattctgtttggagggcgccgaattactgctctttgttgaaactgtgcctggattctagacctatgattatgaacttcagaatatcacaaaggaaacataggtccatcttcctgcttttaatcaaagtccattgatcttcctgcttttaatcgaagtccctaacttcatgttaatccaatactgtgcagtttaagatctatttgcaaaaaaaggatgagaaggaagcgatcaatcaaattcaagccatggttagctgcattgacttcaacccagaattcctcaccctttcgacccatgaagccattgcatgtcagtctcttgctgtagctgtcgcttcattatctgtcctcctcaacctctactccccagggaagccaatgccaatgccaatgccagaggtggcagtgctccgaaatctcatcacccttcttcaaaggaatccagatggggagattgagatcctcaaatacacaagggttgctggggcccgaatgaccgggcttggagtggaaggcttctttgggacaggagctgttgggagccgtgagctaaactggtttgcggggaattcatggaatatggggctgaagactggaaaggagaagaaatatgaagcctgtgccgagttcttggagctggcatcggagttttatagcgtattgaatgatgagagtaatggaaaccaggtgatggtttgcaagtgtttgatcctgagtgtaggtgccatgctcaatgtcgaggagcaaaagaaggttactttgctggactctgatatcaaaaaggccattgaaatgctcggtagagcaggcaaggtagtcagaatttggagcagcttatcatacttcaagaataaattgtaattgaatttgatctaattctcaattgcatgcagatactccctctagtctcatcccgagtacaaattgtcaatgatcatcatgctgaatatcccgacctcttctttctccacacctacaacacctatcatctcctgagcaggctcggcaatgacacccggtcgcagcaactccaactgatcaagagcttcgcttcgtcaaaagtatgcaccccaaatcatctcctccagctaggcttcactgccttaaaaggtggaaggcccaacctggaggctgctgaatttgcccttaacgcctgcctctctgcgctccttgcatccccctcgcctgactatcatttgatcagcattgcgctccgaaagttagtctgtctttctgggctccaagacactgaaggtgggaaaaatgatggggcctaccgtgtttacaggcaggcataccagatcattgtggggctgaaggatggggagtatccaattgaagaagggaaatggcttgcaacaacagcatggaacaagtcagggttagctgtccggctccatcaattcaatgttgcagagagatggatgaaaatggggttggatttggccagacacttgaagggcatggagaagtatagagaggggatggaggagtattttgcaaactttgaaaagctttgtggtggtggtgtagttgatggtagtggaggtaacgaggggaaagagagcagcagtggatctcaaccagtcttggtatagacattgtcaagattttgttaaaaaggaaagaagatacggtcaccaagttgattcaaaattacatgcatgcaatgtcttcgtattttcttccatgacaggtaaaggaataagaagttggtaaagatttacaggcactgatatgaaagaggagtaacgtttgtccatcaaaaaggaaatagtagcatttgaagatggatttgtaaataaaaattcaaagcatcccgtgtcaggactcaggctgggaaaaaatagatgtcttttagtgtgtgcaaaggttcaatgaccaggactggagactggattccctgcagaaaagtgtccgtatgctattgtaccggcattttttgttaaatcgaatcgaactagtttcttagttagtgcttttaccatttcagcttgatttttgaaggttggaatttcagtgttattcttcaccatgtttgaactgtccttcccatgcctttttcaccggtagaaacaaatggtatctgccgtatctgttttgcaggatttctgtgaatctaatgtgtctctccatacattcgggtaccaaatcatctcccgaaggaacatgtataagtacatagagagacaaaccagcattgatattttgatctgctgaagcttttgtgttcttcattttgaaattgagagctgaacacccacaagtttcgcagcaaaaactgataagagtgatgtcaaccctcagatatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcacttgtctctatttcctaatcttgttctcccttcgtggaaaggaaaaactatgctatgcacatggagattgttcagatggttatagtcctgtcttgatgcatacatatcaagttaatatgtattgaaaaaatgcaatgttgtgaatttgaaaagtggcaacatgtcaaatttttatatatcaaactagactagtttaattcttacagcttgactctgatgaattctgcaaacaaaatggagatcaagattagcctgaacatgcaaaattcagaaaagcaagtgtctggattaatgaaatggaccatcaattagtaacaacatcaatagattattgaagtctttgacaataaaattgcttgacttacatcaagcagaagctattatttcaagtttttctgaatcgaagtaaacactacacctaaaattgatggctgtacccactccataacaatatctccccggttgaagccctgtcagccaacgaatgaggcactccctgtcagataaacctcaatcagccagttggcggagcctactgctctaagcaagaacctgggtccattggagccactcgaccaggtccagacaatggtgcagcagcaacccccctttgattcagcaaacacctgaagcgagccaatcttgatgtgacttgttttggatcctttgccagcttttcaagtggagtccatagccgctcttgggccacaaaaagcaaatgctttagtccgcagatctttcaaagaagcaaaatgtaggtacttacagtgacaaacttgcacttgttactgctaaatatgtatgcatatagcaagattaatttgactttgcgatgacaagcgcattcaacaacaagaaattgagacttagcagtcaatggcttttacgctggtgctattatgagttcattactgaaggaactaatctgccttcatatgtatctttctttcataggaaagccacaaagtatatcacaacagatatggtgcaaaatgtacagattaaacacacggaaatcagactacatcaaatggctggacacatattgatgtcacatggttgttgcagattgtatgtcttctgatcacatgtagcaaactttgtttactttttatcaacaaaattgtgcatcacataggagtgtattaaaggagaatttaatttgcagatgcccttctaagatttctacattcatgcactaaattagaaagaaatttttgcttatctagtcatcttgaggtttctgaaaaacatcatcaaaatatgcatgcagatttgcagcatgttctatgcaattaagcttggatttgtatggagattgtgaagaaaaactaggtgtggaagtgtaactacatgtgcaggatgaccacatccagaatgagaaaaatggtaataataaaatttcagcactagttttaaaatgttgtaggtagtggtccagcagaaagatgaaattgaaagcaggctattttcagacaaaatcaagcaatcagagatacatggaaaatttggtacaacacaggctatctttcttcaactggagacatgattggacatctaagtttgttattcaagatcttcatgaatgataggagtataacagaaaatttagccaatagggaatattgaatctgcaccaaaattaattgttggttcatcatcttgcaataacaaaaagaaataaagcactaatccaactaaatacctgctgctgctgcagcacgtggccatatagtttgctcaatatccgaggtatctatgtgttctccccacatgcatacttctccaccaataaccagtttctgctgttcagggttggaaatatttgtgagtggctcattcatatagaacttcggccatgtggtatctagatgatccaagtaccaactgtcctggttgctgacaaggcaccttagaccagcagcaaccacccttggggccactccaacaccaagcctatcagagtgtaagaattagactatcatatgtaatgaaaagacccgaatatgtcataatcatgaatatcaacttttttctaagcactgataagtgttacaggatatgaatgtcctatgcttatatagggttttgtggtttgatgaagagtggaattcaaaaggcgagcttgcttttgattttttttcaggaatgaccactgtatagacgcagactgttggaacaataagtagagagaataatgagaagaaattatgtgattattcctaacaagtctataaggccatctcaaaaccgataaactaaaagtctagaaaatttaagacatcgaccaccacttcatttgagatcctaaacttatgcacacttgggacaactgctgatgccaacagggaaagctgattggctgtctctgaagttaacatgggaacatggtctacagtaccgccctgtatggggcatgctgtctcatatcataccgacacttggtatgctgtctcgtactgtactgaaccgcatactgacacgataatagaatgatatcaatatggggtccgatgccaaagtggtgaaccttgtatgtaaatatgtgaatcatgctttgttagcttcagatttttattggcccgataacttaagtcttcataaatgtttatatattgccacaaagtaaaaacttaaaagaaaagcataaaaactgaagtaaaaatttaaaagtatactgcaccgtaaatcacaatcccatttcaaatccattttaaattaaagcatctctcagagcttggttcagtccagtttcagggtaatatggcaccatttcgcctgatatgggtggtttgatccctgagctagatataaaaccaacatgcattctctggactaaacaatatttcttgcatgtatcttcatcaagtagaatggcatcatcagtgattcaatgtagaagtcccaaagaagtgatttatttctaaattggtggataagtgaggagtttaattatgggtgcaaccttatacacttgaaaatagatgaatactatgagcttgttacaaataggtgttctaagcttagttcttgaaaacagatgttgaataaatacatcagtaaatggatgagtgaatagatctatacctctgatatggatgaaataattcccacaattaaacatagatgtatgaataaaattgaccaatttgatgttttaatctttcaaggcactattccaagacacatggattgattaacatatgttctattatacttaaggacatgtcctgcaagctagaaaactataacatattcccagtaataacgcaggttcttcatagccagacatgatggttaaaagaatgcttttcttttgcacattaacaggcacaacaagatatcttgcattcaataatttagaagagataccagttatgcaccactgttttagggctcaatttgttcccgaagttgtcgaatgtctcctccctgttgcccatgcaataacatattttagagcataaaaaatttaggatgcataaacctgataaaatgaagtttccttaccaattaatgacttcatatccatgtgatagtgctatcttttgggctcgtaagacaaagtattgataggcatcggatccattcatcctatgctttttcaacctgcagaaaagaaaattgataagacttactagtgcacattagaaaatgctaattttcagaatgaacaccccacgagattacagtaagcatcacaaagcaaagtagagctctttatgaaatgtaaaaagatgatccgaagaaatgaagcatcactaagaaataatttttttcttttcacaaagaaaagtaggtttccttatagaatataaatataatccacagaattgaagaatcactaagaaataaagtttctatccaaccagtcttcatgatacatatatagttatcaggttcactatccaaagtgttcagttaacaaggtatatgatactagactgcaagacatgacagtcatatagaaaaatactcttgttattcatgaactttctattagcaaaattgtctatgtaactactcctgtagaatggaattgtttacagggtactgaacatttaagatttttcagagacttattcacaatttggtcatgaataaattattggataattgatacattctgttttgccttttttttttttttgctactgtctttaccacacaaatttttctatataagcatatgaatattaattatcatacatcttttctgtttttgcaaatattttctgattagtcaatatttcccttctacttgaactttggcagatctcctacaattttgtctagttctgaacatctagatttaggtaatgattgctttcataatgagctacaatggttgcttgtccaatctacagtttactacaaatacatgtcatgtaatttcagtgattacaatgagtctactgtaacagctatggttggaaggtaaaggaaggcatcttcacctacttgcagtggcatagattggaatgcataaaactcaagtagaaatattgttctattgtggcaagatgtcaactggaatccacaaaaatagtgtatgaactacagtgaaaatactctgaaactcaaatggaaattcagtggcattaacattaatagactaataatgcttccacaaacataacagttttgatggctcttaacagtgagaagaaaaaattatcataaggaaaccacgtaagaaaaagcagtaaatatgaatcataaccaggtttttgtgttattcttggtgtttgcaagtattctgcaacatgcttttcaaagtttttggcactttagacaagagcaacttcaaaagtcactgggccaccacaagaacatcttcccaactaaaactgctcttgaatgagttctctaggtttaagagataacacgatactgggagcaatcatttaagtcttttacttttccgcaaagtcagcattctcattcaacaaaagattttcaagaatttctctagatcgtgaccagaaacatatatcttcagaaaatggatgctcagtatttgagtattgcccttttttaaggaaatgtaggattgatcatcgaattaatgagctaagaagaaaataattaattttcaagagttgatttgacatacatattctacataaaatttctatgcatcatggtgatcttaaatttatgcatggattgactacaatgtgtttgaagtagatgatgcttgtttaggatgtattaatgttcaatcagtatttcgagatcataatgtggaagatctggatgctcaaattcagttatagcactgcacgttgtatttttatacaaatgcaatgttataaatagctattatgtggctatcgtgcaacgaccgtatagccttcacttttctgaaaattgatgaagagactagcatatatttggaagacaagtgcatatatataatgttcaccattaaattgcttacaaagaattgtttttgcaatgactttgcgtttggattttttttctctttttcagatcatgattccatttccatgttctgaaattttgagccttgagtctagaagttttctaggagatgataggctgcttaagactttgaaagtcatatgatatggagagaaaaaaattgatatggggagttctacaaaaaggtagaaattcccagattcatgatttcaaggccttgatgaaatttcattgcaaaatcagacacctagtataataaaatcataacttgctatcataaatacatttaaaatcatgaaaaatcatgatttattagatccaagtgcgccgtaagtaatcagtataaagactagtagtttagtttttagaaaattggttttgtttacatatattacgggtgtatggataaattatataagcgatcgaaaggttggccacatttttaaattattttccaaaacttaaatcttcaaaggttttaaatttgtttgtttgccatatttataacgcatggaaactacaaattattttctgcatctagatccaatggatgctagtgcatggtcgacatgtggtgctatagtaacctgagttcaaggacagtggaaccatcttgaaccaccctgttcggggcataccgagcataccagcagtagaaaaagacagttctagccttcaaatcgagaggttggcaaaggagggggagagagagggagggagaggaagaggaaggaagcagagaaaaagaaagagggagagggcagcagtgagtgagggccaccgaaaagggttgagggagggagctcctatttcgaaagaaaataggggcttcggcccttttttataatttttttttgaattttttaaagtgaagtcaacagccactatctatttcacttattatttttaaaaaatttttaagtaaagtcgatagtggctgccaacttcacttcaaattcaaaaaataaaaataaaaaatggccattagcttcaccttaaaaaattcaaaaaaatatatataaataaggggctagcgcccctgtttcattttgaaatagcagcttcatccctattccaacacagagaggagcaagggcttcaaaagccccctcccccctctctcggccttgctctagtggccctcactcaccaatgccctctccctcctctcctccctctcccttgctttctttgtctccccctctctctatcttttcctatctttcctccctctccttctccctttgcctcttcctctctctgccaccctctcctacaatctcccttcctcctctctatctctctccccccctccctctctctctcaccagtttccctatcggttcatgccggaatgccataggggcatttaccatatcataccatcagcctaccagcataggtgctgtttccagtactacggaccttccttgagctagcattacattcataattttcgaggaactgttgaataccataaaaaatgaaggcatttactacaaataatatgttagttttggaaagtttattcaatgtatacatctcttttaccaacagaagaaattacattgcttaacaacttccatcgctaatactaatctatgtcatgattggaaaaagaacaattatgtcacagatgataactaagcctcactgtgatgtatcaaaataatagactggaagttggagttatgcaaatacataccattgatttacatgaggggtggaagtccagcaacctgaagcccacgtttgaacaagtaagtatacatctaattgccaatgaccataggattataataaaaaaaagtgcttccatattcaactttgataaactatttcttagtaatgtctctcacaggattctatgaaattagttgaaatttgaatggaaaagacgataagcaatcatataaggactggctattaaatacctcacaaaatccaaggatctaaggatattttattaagagtagtaatattaaagggtctttgtccctgaaggatgttttaagcatgattactatcatcatgagaacaaaatttcacgtgatgagatatgcaaaggtatgatgctactaccaggaaaggttataaataaaagaatttctcaaacttacttgtgttgacttcatcaccgcccaaatggacaaatctgaacttaaaaaccttactaaaatctgaaacattgaacagaaaattaattgcttttgtgacaattacaataatcaaaaaatttactcttttcatttgagataaagatattcatatattatgtgcctaatcaaaagaggcaaatggaaattctgtgagcaacataattatgcatcaaagttacagaattttgtcaaatctatccttcaagaagtacgtttgcttcaagccttcccaaataaattcatccataggattaaaaaacactatccaaaagaattataccagaattttgttgatcatcaatacttcgcttaagtgcttgaaatagtagctctatctaatacattataactctgaaattggatctcgactcatactcaaaataagcattggagggctataacaagttcaagttttttcacatgttccaacattaggatactttagggcatgcgttgacattgcagttcactaaacatggattatatcacataggtgttgaaaaaattgacccaacctgaaaacctgaaccagcctgactttatctgggccaggtttcgttcagggatctttcagtttggttcttgtatgggtcaaaatttttgacccaaactttaaacagaccgggtagagttcagagctttgacccagattgggtcatgaggggttgaaagtttttattgacatcagggtagtttaggtcgggttcagtcctgatgttatgctaagagttacatggttagtcttctttgatactaatttttgaaaccatctttgaaacaaatcagtaagaatttcaaggattgcaccagacatgttacattgagtccattatggagtgagccttgcaaaatatattagtttctgagtcaaacaggttagactgggtgatgtgtattgacctcggcaggtatggatcaagggatcttgacccaatgtcacaattcaaggttatgcaagttgttttaacttcacctagcctgacttgttgcaaccctaacatcaccatggagcaattgatgcagttcagtgacaattatatgaatacatccttacatagtgacagatacattgacaagatatagatggttcatgtcaaatttttgattgatttgttgtcatcaagtgtctgcatctagctagcatctgttgtattttcataacagagttaatcatttttccagatggacaaaagagagcgatgattatatcacctgaaagaattccatcaattactttgaatgtaaactcattgctgacatcaagtggctcttggcaatcagcagatggccacagagaaggataaccgacacccctgccaggaaaagatgtcagctccttgaagattcttattgtggattattgttcagtgaaacaagaatgttgttttcactccagctactccagagaaatcaatgacatcggagttgggtaaagttattaagagacctatgccatgtcatgctaacccaacaccaccatggtatatgccatgccatttccatggtatagtgttgtttgaacaaatatcaacaccttattctggctattaagactatttcagtaaccaatagtacagtgttgtatgaacaatatatcaacagcatgagcagaatgcaataagctaacccacatagtccagacaagatttgatggatagagtcatggttttgtcaacaccgtccaccaccacaaaggtttcaggtcctggtatttagttttactgttgtaaacctcccagaatttaacggaaggatataaatcggaggtacgttgccattcttcccatttatcccttacattgcacacaacagaaatattaactggctggggacaatagtgaagcaacaagaatgcatatgctgctgaaagattctgcgcatcatcaactagtctcatagtatcaatatgtaaatgggagtgaggatgatctgatgcttcagtctatactttctgagacaaaataagatgcaatttcattatttaaatttttacttttgcttttttatgtctccagcttctcctacttatgaagatgtaaaggacacatttgcgatgatgatagatgattcatgttctagtcactgcttatttgtgatatcgaacattttccagggacttggtccattttatgccatgaactttccaagatattgtcaacccatgctcaatatattcttcaccaagttgattgtatagcatgccctttacatgctacatatattctccaaatattatgttagcctcatgtacaaacagaaaaggaatcttgcagtatttccttagaaacacaacatcaatctactcatgccagagtcaaacttcaaatcctgctactcatgcctgcagttaggtgtagcttacagaacacaacacacaattttctagtccaggtattaacagtgacactcgaccaaaagttttctacatattgcctactgaaaacaacattttctgattcttttttcttttatctatatgcagagattttcttttttatagtcgatctcaccattattgcacaatggacttcggaatttttattttttaatctcagctatataaccacttgactataatagagggtctgttactgcttattgatgtttacattagcatgatcttcttaatgagcaaagatgactaaaatttggggttcctttacctttaatcaaatatggttttcttccattctgatgtatcttttgagcttaaataggttagcaacacaatttatcattatacaagttcaagtctttttagttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacacaaatgattcaaaaaatcttagctgattttcttcttgttttaactttatgaccaatgctttcaggcagtgcaaacaatacagttttgttttcatagctggtgtacagttgagatgtgaccagcctaagggaggtttgatctaggaaaatgctttcacaatcaactttatcaactgaaaagaaagatatttaggaagacctattgcctgaagcacaattatgcttttaaacattctgatttctgatcgtttatggattggatggttaagcaacagggagaacagatgagcgacagatattctgctatgatagaagaaattgtctaatggtagttgtctgcaaaataagtgcttgagatggtgtgccaggaacaatatcttagccgtggcccttgcaaatatggcccatcatcttgcagatctaggcacaaaggaaggttatgctgacagcaggcccaagatgagaaccggtcatctttcccaataattacaccaaatcaagttagctatcaaacatgacccaaataactacagaaataaagacttactggacaatctcttgagcatcagccatggtatatctctctgtataagagtatgccccattccagagtcttggatatgaaggtatctctagtggaaaagattgcttatccacaatatgccaatgaagaacattctgcaagaaagtaataatgatacaaagttattttgagaaagcataatgcagaggtcctgaatcagggatatttgcataagatttcttttttcaaaaaaaaaagggccaaaccaccatgtacatgattttgaacaaaatttgatggtttaatttgaaatacaggtactaatgagcaagagaaacagcagacattcatggaagtagcttgagcaaaataaaccttatgcaggtactagcgagcaagagtaacagcagacatttacagaagtagcttgaccaaaataaaccttatgtcatacccgcagttatcacacttaccaatttactgtaggacattgaatcaataacattctttatcactggtacaggcagataatgccgtgatgtatctgcatcacacggagtaaaaggaaacagttagaaagcatttgcatgtataaagacgatcatgaatttgtgcatgaaatgcagtgtttgccatgccaccctgaaccacctattttgaggcatacaatgccatggtatgaaaacactagttgggtctgcacgggccccataccaaagtgtactgaggtgaatcagggtgcatgctgacccataccacctcatttcaaggagtattatgataaaaagtgataaaaatggctctaaagctatgttggtatatggtgcatactgtattgcactaatctgtaccgcaccgaaccaataatatggtactcggtaccaagattgtggaccctgcacaaaagtgtcctatttttgtatatttttggaaagatgaaagcaaacaacatcattttgctcacataaaaatggtggagaaattttcattctattaaaggtgaaaacattaaaagtagatatttgggataaatgtcaaaagaaaaaagtatatttattattaatgaaaagtgaaaatgcaaatgaattgtcaaatagtaggtaagagaagtagcatgtgcatataacatgatgtgcagacaaatatacacagttgagatggagtcccaccataggatttgaacttggataccatccatgtaagataagttatttagatcgagaatttatatccttgattatgatttataatgtttaaaatgtttaaaatcataatcaaatagtttgaaagcttttaggtatgtttctactgattataaaatggatgatttttaagggcaagatataatatttagttttaaaagggtccaagctcactgtcttctaaattctatatctgatcaatcaattgcatcccaaataatcaaattatacgattcaatgggcatttattttgttctccctcagctgtcctcataaattttacaaattattgttcagcaactgcaaaaacttgtttttaagcatctagacgtattgcaagatgcagattgagatcaatggggtggattctcatttttaatggtgcatcacataatggagattgacataaatttaggctcaaatcctttctgtaagattataggtttatctttctaatttaggctcaaatcctttctgtacgatcataggtttatctttctatcatcgaaagatgctgtaatcgagaaaacaatacagatgtaactaaattgcatgacatctagcatctaccccatataattcatcggggctcattcatgatatgaatgttattgcttttataataactatttcaaatattatctctacagtgtcactacaaacacatcatgctcatctaccaggagtcagccagagaaaattttgaagaatcttttgatggatagcatatttatggtttatcttctcacattcaattcattatgttcttgtttccactattgaaaaaatatatgcactctcaatatccataggaggcctttggtatgaaagacatattaactaagcatatgttcaccttaggaaacttttactaaggaatatgacattaataggcacataagcattaaaagtagccatacagatcatgaagcaagtttaatgacacatgggtatggttttgatattcgaagctatgatttcataatgtagctattttcttgtgcaacagaagtttataaacatcctaaaatcgtgaaattaaaattctattttgaatagaatcttctaaattcattttctccctccttatcatcttgcatcttttcccattttcaactcttatccttttcagaaccaagcacttctagaagtttgcggctctcaaaaattcaaacattttaaaactagaagagtttgcaattttgatttataatcttccacatacagccctagaatttattcataaaattggtacatctggctagtcaatttctaaaacatgcagaaaatgaattgagctttaaaagtattatttagaaaaggagaaggtcaaagccacatttcgttaatagtgaaacattttgttcaatggtgaaacacatttcatcttacttgtatgatatccggatcctattggtggcagaacttcttggacatgtcatagtattggtgtacaaagtcagaatggacgtttgatattagccatcaaaatcaattgcattcatgttagaattgcatccaaggaatgaaagacagaatgcttattcttgactcaaggaagcaaacacaaactccattatataaaccatcaatttaaacttttttgaggaattatgcaagcattatccaagagaattgtatgagccagcataatttccagaatagctgcagcaagcttgccatggattggtccaactgtagaagcacttggatacacttggaagcctgtgaatatatcttggttggatgccttggtccatacaacagtagttaactttcagatgcacagtctgcatctgagatcacagatgaatgcagatcaagttgatggctaacaatttccatgttaaaatacaggtttttgtgacagcaaaagcttggtgtggctctgatagtatatgcagaaatagttatgcctctcattcctagacttcaacaaggtcaaccaggaggtcaattatttttgggcttctgtgaatgattcaggctcactcatgtatctccttgatgacttgcaaatcatgataatgactctaaaagcaattgagtctgatatcatgcacatatcagcactaaagccatcttcagattaaaatgacaaagaggatggagcaggcaaggtggtgagacacagcattataggtcccactggttaggtaaaatcccgacattgagacatttcaagcatcatagaatacagaacgagaatagttacatcattttttagtgtgcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactgcaagtagagttcatccggactcctacgggagccggacttcgtctccgactccggctctaggaagacttcaaccggactcctacgggagccggacttcgtcctcgacttcggctgcaggaagacttcatccggactcctacgggagccggacttcgtccccgactccggctgcagaaagacttcatccggactcctacgggagtcggacttcgtccccgacttcggctgcaggaagacttcgtccgaactcctacgggagctagacttcgtcctcgactccgactgcaggaagacttcatccagactcctacgggagccggacttccacccagaactcctgttgcaggtagacctcatccgaactcctacaaaggccgaactccgaacttctaccgcaagcgatctaccccgagcttctgctacaagcggtctacttcatatttctactacgagcggtccgtgccggattttcgctgtaagccttcacccgagctcctctcagatggatagctacctctttccgccagacgcttcgaccgagcttcggccgacaggccacagtaatggccacgactctgctccacctcctgcgacggattctgcacggctccaccactccccgcaacaggctccgcacggcagaccgcagtaatagccacgattctgctccacttcctgcgacggattctgcgcggcttcatcactctctggcaagtcacgacaacagacgccgctccactctccacaacaggctccacgtggcgggtcacggtgatagccacgaccccacccatttactcttcataacaaactccttcaggccccgagcggcccactgccagacggttacagacgtcgctatcagtctgttgcactctccacctataaaaggggaccccagatacgttattttctaagctcgcatttttatctcaaaactctgctaaaatttcgttcgagtactccattcttgttgaggcagagaactgatttaagcgtcggagggtcttgccggagcacccccaactccggtttagactttctttgcaggtcctggcggtgaccgcgactccagcttctccgacgcaggcggatttttgcaccaacagttgcaaaagcaaaagaaaatattgaaggaaaaaaagaagaagaaaaaaaatgttagatcgaccttgtttcttggaaaaataaatgtagatagatcattaagagctaaaatagaaggtataggaaaagaaaaaatatagtggcaaatattgagggaaaagaacagaagggaagcacggagagagagagaaagagagagagagagctcttcacaggtcaaggacctaaccagtcaaaacagaacaatatcaacaatctatacgggagtgttgctaggtaggtcatctacatgaaactctgttagtaattgaaccacctacctaggtaggtcagagcatcagctaagataatacctcagatcagtgatccatttttagaataaactacaaacaagacactaaaatacctagcaattatgtcatcacagagcacaagtgtgagacaaattggtgtgctgacattgtcacttaccccacaattgcccttcctagtagcaatatgcaatggtctgttccccttgttatcttccgaatgaattattgacttatcaggcttcaccagttcttgcactatttcgacattttggcctttcacagccatgtgaattgctgtctgccccttcttgtctgttcttaaaccaatgctggggtccttatttaaaagggattttaccacttctacatgacccatccttgcagctgaatgcagaacagtttttccattatttcgtgcaatcttagcaagactagcatctgtttctagcagaagattgacaacatccagatggccttgagtggaggcagtgtctaaggctgtagaattcaatgaatttgtagtcatcgccagtgcgggaaaagaatgcaacagctctttcaaaacttctgcaaaaatcaagcaaaccaaaaggagaatcagtcgtaagagcacaaccaacataatacagtacagaatcataaacaatcataaagtcagacagactaaaatctaaaaatttacatctaaacatttagggagcatgaacagatattttctttttcaaaagaatcagatggaaccatggaaaaaaaacttccagagtttgagacacagacatattgttcttgggaagtggaaatctattaagtaacaagatattaaattaagccacacatcaaatagtgcagaatacaacgagaaatagatccactaaaaattttggtttgtgttcacattttgttaatagaaaatggaacaaagaaatgactcttgataactatattcaggatatgagagaggtaatccatgcttcaagctggtaatcctcaccaattcctttttttcattccatacatgataaagtaaataatgcatcagtatgctgcccaaaaatttgaaatcttccatctttattggagtttgtatgtacattgtacataacatgctaatcagttccatcaatacaaactatagcacagtataatatcttacttacaggttctcggtcatccttaaccatatgtatctagctttatgtttcacttagataaaatatcagctgtaaaactactaggagtattctctggccatcagagcagtggctgccatccccaggatcttcaagagatcgtttcagatgtattatcagaaatttctacatttattttttacaacttcacaaatgttgaattgcatgtttaggaaatcctcctccaacatccagtattgacaaactacttccaccacctagcaatcatgctatgtgttggtttttgcttaaaagttatcaggactgctctcaaacacagaattcattttgtattcccttgtggtactgaaacaactgcactagtcaatggtgatcaaaatcacatttatagctaatgcacagcagattttgaggcaatagaattttcttctagaaatcttttttactttgctgctctagctttcaaatcatcctgtattcattcttttaaaataagtgaattgtagatcactccctctaggaacttaatcagatacttgaattaattcatgtttggatatttgctacaccatctactccaacaagtgtgcccattttgtgccaaatctctttgacctttttaaggcgttcaattaagtgtctagtctattgagcttcactcatactattttccattaaaaacctcaaacagattaaatcaagccaataaaatctccttcatgtttccccaatcagctttattcctttcatttttgaggattttgtttgaatagaaccttgctaggcctttttttttttttttcacttctattattttaagcattttggttgtctcatctttctcacccttacagttgtagtcaaggattaaagtcctagtattagcaccaactcagattggttcttggttggcatgctatcaagacaaaccgagatggaactgttgaccattaacaacaaaaataaagagaaaaaaattaaaaaataatggcatccaaagatgccaagcatcccaagtgtcaggacacagccattatagtccatcctggatggtgctaaccagaacagtaaggacctctcaatcccggtgtccatgtgcatcctaggtaccatccaaatgttgaaatgacaccgaaatggcaggatgtgccaggacccaactctttatttatagcagttaattaagttctttaatcaaattccaaacatgatctccaattgttacatttggacagatcaaggtccacccttgatccatcaattggattttttgaacttcatgtccacattccaagtagtggcatttaatctttaataagtcaattcgcttctcttgatggcttgccttcttttgatcaactttgtccagttctgggaattttagggaacccccatctatttcaaaggatccacatcttttagttacctagtaggctttgcctacttcactttgagttaatcacaccttctgctacaatcctaggttagtgctctctctattccccctcccctctccctctgtcctcttctctcagagtgtttagttcagtctaggcttccattgttaactgcggtgtaacatttcttccattttgggtgtttaagtcatttcacatttctgtttttcatccttaaaaattatttttcaccttacttttagctggatacaaaggttaccctttcgacttgctcattccagtaaaatcttttcattcagtcacttcacatcatcttagacctcagaatttgtgaccttcaacaaccgttgctttgcttcaaacaacttctgacacaagcattaccacttgtttccccagcagacccaccctgagcagtcaaaccattcattaacacaatcccggaagcttctgaaccagctagttatacttcatgcacataaatctctcgacttagccatttcatacctgttttagtgtcttcagattctccttatgatattgtcatctgaggcatgttggctgctcataagtcatatctgatcagccttatttgtttgcactctagcatcaaattgtaaaacctagaaattacatgccactcctcaccatccagtttgcttaactgcaagttgaccttgctagccaagttgcctcggtagccagtgacatgaataacagaaagaatagttccccatttattttgttaagatttaaagagtctacaaagcaagagcaggttatgattgttgtttgaacaagtttattgcctaaagttgttccctttctaggagcatattaatctacttcctcaatatgatcatcagctcaccagcatagagtcacttaattgtctgctttgcaaactagagcttcttttaaatgtcccatcacttctgtagtttcccttggaacctttcatcttgttcctgatgttgccttgccacaatttttacacaagtttgtgcctttcatcctcaagaagcatattagttcatcattctagactgaccacctctcacatagatattccttcctattttgtgccagtaccttttatacattctcatttttcactagcaaatctttaatctctgtcgctctctctgtattttataccatgatatggcagtgcatttacatagaacttgctctcactatttcgccaaaaataagatatgatgtcgttcctccactatcaaaaaaggaaaaaaaaagtctcacacattctagttaactcagtgagaattttcaacaaatcaacaagatactgtaaaatatcacaatgtattcatgaaaggatccatagaaagtaagtatgcagaaacagcacaaaattaagcagcaaagaaactgcttattgtcaaggtaatcatttaaaacaaaacatacattgactgtcaaatataaaaagtcaggccatattatccaagatcatcttacaagaccaaaagagatggtgaattcaatcatttttaaatcacagcaccaataaccatgacaagttctagattttataatattggccatgaattatcatttgttttgacactatgtattaaaacaaatacagaaaggagcaaatgtaattgatctgtgagatcaatagcttacccagatggccctgcttagcagcaatatgaaatgcatcaaagctgttactggccttagtgttagctgactgaaagtctgaaaccttcaatatctcccgaacaacctcaacatgacccttctctgcagcaacatacaacgctgtttccccatcttgattctgcttagaaatcaattctttcaattggctctcaccgcaatcagaaagaatcccctgaacatgcactgcattgccagctctagcagccagatgcaatagtgtatcccctcgcttcccagggctttccttgttcctcctctccttgaagctctgctgtttatccatggaccccaaccgaaagctcttttgtttctccaacgatcccatccgaaagctcttttgtttctccatagctcccagacgaaagctctgcaatttctcgaacgctccaagacgaaggctttgctgtttctccatctccacagttaaatagttcttggatcaaagaatttccttttccttccctcttctattctataactttctaattaataacttcactcatgccaagcatctcacccagaaactgtggccaggaaatctcagtttttgactgtgagacaagttttcccccaaagtcatcactgattgggtggtcctagatcccatatacttgttaaggacgagaaccataaaaagctgcctgggtctcaagaaccgagattttcaactatatatatagagaagacaaagaaaagaaattgatgtgaaccttcttttaaaaatatgcctttcagaaatacttcccttcttccttcttcgaaagcaaaactgaactcacaatctcaagaaacccaaacacaagaaggcaccaaaaaagacaaagatttcgaagaacagtcagaagcaaaagccctcttcttcgtccacaaaaccctccttaatatcagcaaaacaaccagctgcaagaacctagaaatccaaaacatccactaatctaatcacagtgatcgaggatcgacaaaaagagttacctcgatgtctgaaatccagaaatccccaacacataccggtgctcaaaatcccaccttttccagatctccaccacacaagcagagccccctttctctccgaacccagaaaaccttaaaaacggaagggcgacgagggctcaactcctggtgggcaacctgatacacctttttctttctctttttctttctccatctaccttactgattccagaagctttgagtacaactgaaaaaacacggtattctttaccccccccacaaaagagaaaacacggtattccggttggtacagcgcttgcgatccacgagaaaaacgattccttatctccagtggcaattaccatcctcccactctaaaagccactcgcgcctacctcccggtttttgcccctggtctcgtgggatgcgtccaagagtgggcggctcaaaaagcgtggtggtggtggcggtcgtggtggggcagcgagagggtaaagtggggacagcgcagacaaaagagtccaaagaaagcagtgggcaaagattccaagacacacgaacgtggcccatcccaagtgcgaagaacaaaaaatctatagctcgtacagtgctatccacatgatgacacgtcagcctcgctatgcgcggttcctccacgggacttggcacaagacctccctggttctctcactcgtcattggtggcgctggctcttgtggggatactcgaaatgtgagggccggctcgcggtggatataattctttttccgattcagataggtgatcacacaactcaaatacggatatgacccataaattaaaaaataaaagatctcgcattattcgtggacacctcccattctatagctagatgtaattcctaatgtgcccgataacgtaagaagcggcccaatccaaacagacacgacgatggactcacgacgatagaagatctcatctatcttctaaattattagatattttattttctattagctacaaatgtatttgtttttaatcagtttcataaagttaaaattataaatatgttttataaatttttaacatattatatttaatctctttatcccattatgagtcaagttattgcaacaatcctatatgtttcaaagaacttatgacattaaaaaatagaagaagatttaaggacaaattataagtgcataagtgcaacaaaagatctcaacttgtcagatattaaacttggtacttcaatgtcttattggatctctttctaattctaaaactaaaaatacttaaaaaattaaaaaatataaactttgaaatggaacttaataaaagtctccgttaggccgagggatgctcatgggcatacaagtcaaagagcctaacttcaaaatgaaaaagtgcattctttcacatttatattataactagtttttaaaccccatgttgtgcatggatttgtatatcatatttatataattaattatatttataaaaaaattaataatatattcatttatatttttaatatttatgaatattttaataatatcaattaataaatataaataaattttaatatttttataaaaaaaaattatgaataatatgtccatccatattcttgatattcataattgaaaatcttaataacatcagttaataaatataaataatttttaattttatttattaaaaataaaatatgtacattcaatattttgaaatagaagagtccaagtagtatgtatagaaaaaaaatagactgcttatgtaaatagctttagttacaaatcaattgttttttattttttaatatatatatattatattagatagtaaagtaatacgtggtattaaagtgttcttctgtgcagacaggttggattataaggtaacctcctgtaataccacgggtttaggtttgatttatttatttatttatttatttctccgcagtgtcctcaccagtcgcttcattcgatgcggagtcgggagccctctgatcagatccgatctcttctccgttggccagagcagacgtggggcaagcggaccccgttaagccgctcgccgtaggggctgaaacccaactcgacagccaggccccccgctgccaccgcctccttcggcggaactggcggcagcatcaccttctttttgccgccgccgggcccgccgctgctccgccttcttccccgtgccgctccggtacttgagccggacccgggccagccagttctcgaaggtggggtcagaggtggcggatgccggaggttccgcggggggctgccgaggaggaggaggaatcttggtcggggttgggatcgtcggcgagcgcgtgaggggcgagggggaggggttttcttcttctggtggtaagtggggagggattgagggtggaagagagcgatggatgggggatttggaaggatttggggacgacgccggccatcctcttctattctctttgtgttactgttaggtcttcttcccctggttaaattaatattctttttgtgtcagcttctccgagtccgatagattttcagaagtggctggaacgactggcttctattctcttctaattatttcataacttttccagttagcccgaggcttttttttttttattttgattttaaatagcctacaaatatatgaaagagagaaagagggcttggatattatctaaaaaatattagccctttttcttttcaatatctgccgccggctgatggtcagcgatcaggaccccctcgatgccttctgccaggagagcggtcgggacccatttcttgaactacgatttatttagaaggaacgtcatctactacatctattacgttctaaaaataaattattggataaatatgttacatgaacaatttagatgatctatgatattaatttatcaattaaattttatatttttgagtctatgaataattaatttttatcatcattatgctagaatctatataaattatctaactaatttatattgattagattaaatatcatattgattaaatttttagataaaatgatcaataaatattatttattttgatctaaattattattttaatttatttttttattttaattaaattataaattaaattattatatttatatttatattttattttatgttgaaatttattattgtgataattatttttttatatttataaaatcaacgagtccgacgtcctcccgctgctgtactagtgaaaaagttatataacgtgcggaataaaaaataaaaaaaataaaagaatccatcattttcagcattaagagacgaccacctgttgccaaaagagagagaaagaactttaatccacggaagatgtgacatttggcatgataaagaaaataaaaagatagatatcaatcttgatggctcactggggatccagatctggagcctgatgccgaggatgtacttgtcgatgtcgatctcctcggacattgccatctccaaggcataaacgtcccttgcatccgcaattcccgcttcttatccttttgcttcaatggcagctctgattccaaaccacaaatccattgcattgatcgaagttctttatctaaataatattaaaaaaattataaaattaatacatcttctaatttatttataaaaataatatgaaattataaaatattatttcaaataatattttttgataaaaaatatcatttaaaatgatgtttctctgctccacgtcatctcttccctccctctctcatagaatcaaaaataaaaataaaaaatcatcatttgtaatgacatttttgaaagtgccatttcaaatgatgtttgaaaataatatttaaaataatatttttaaaaatctcaagtgatttaagcctcttctttccttctgtttttcgttctccgctcgttcaccatcgatccctgcttcgaccgctccgatcgatctccgacgagctcaccgtgccgataagcccctcttccttcttccctccctcttccccctcttctctccctctgccggcggcggctgccccctaccctccgacccttggccggtggtagccccgccccccctttggcccgacggtggcccccctttggcccggcggcagccccaccccccttttacccggcgttggctgcccccctccccacctgtcccccctttggctcggcgacagccccgccccctccccttagttccaattgatgacgataaagatgtccaaaaaatgctgacattttctttgaaatattcagaatgttgatttttagaattatatattgaaaaggaagatgtatcgagctttgggtactatagtcggcttttaacccaagagggcaatactcctgggccttcctcgcctttcgtaactcttatggtacaaaccaatagtgttgaggccatgtttgcaaaacaacattctactactgctggctcttgttgtccaattattcaaagtcctatggtgacttctcctgtgatgtcttctgctacggtgacttcttctattgtggaagtagtagtaagtacgggatacaacactcatataggggactcatataggggatgatgactgggtggtggtggaaaaattctgataatttaggttttgagtcagatgacagtgaggatgaagattattggatggatgaggacaatagcagtgataatgatgatgaagatggtgatgaagatgttcatcttgatattaatatgggagaacctcaatcttatttgcacgaacctccataattttttaacaacataaatttagatgatggtggttgtgttagcgctggtcgaagattgaactctgactatcagtagaagaaattataggctccggagatgtattttcaatattgttttatgtatttttatggaattatatttttaatattattttatatctagagatgaactatattgtgtgtttaagttgcattatatgataatattgtgctaccagatatttactagtaatgaattagtgacatcatcattttcatatattgaaaattatatttttcatgtattgaaaattatatttttcatgaaatgaatagctatcatatttctcatgctctaatatacttgggatatatatatcattattttaggttcattagcgtgttatggcttacgatctacggcattcaagccctcgagatagaagtattcttatattgcaggagcaccattggtcatagactattttagatggcggtataaacattccaatcctactcttactacttatattttttataaaaaaaatcttgttaaggtcatatacgttatctaatactactcttactacttatatatgtagcaggacatgtcccattagatgtagatgatgctgcttttgaggatctatttggtggcgtacagtatgatcaggctgatccactaggatgcaggtatataactagtagcactgattttacatgataaataactgtatgttttcatataataatatagtggctttattttggacagatggaggactcgattgactggtgctagcaatttggtgtcgcacatagttatatattatagagatcagttagatcagcagcgtgatgatcagatattatggtgccttacacatcagatatattgactgtattgtcagatcagcatgtatggaggatacgcgcacctctcatttgcttcgacatcatggagatttattgtctggagcacgtgatgcgacagtttggcatgcaccaggacgttcccccactatgtgacactcgagatactctctactatttggatcgacgagggggacatcatcatgattgggttcaagagcatcaggagtatattgatgcatgagagcgatgagaggatttgattgttgctggtccacccatgcttcccatgatggattattatgatccatatctgcagtggtacatgaacatcaccagacgattcatctcgccattaatgagtgagtgtttcgagatgaggttccgtgcttcaggtggtatgatggatattgtggtaagtatattttgcttttatctcattttgttatattgttattaatatacttataagtaatatttatttttttacaatttcaaaggattacatcgctatatcatacggtaaggagtagattccattcgatcattgttgaatgtaaggatcgagcacttatcgatattatggacgaccttattgatactatacgagttgtctcagcggatagatgacttcagactatgccatcgataatcaaagatgagatgcatttatgagagacggacacgtaggagccccaatatcttgatatatacaaagatagttatgatatttgtacatgctaaaataattttgtaatcattaatgttacaatttacactatattagttgcacaaaaaaatttaatcattaatgtctaatatttaatcattcaacatcatttaaccattcaacatcattctttcatactaagaagatatattcataccataaatcaaaaaatactataaaaaaatacagtactacatcatcacactacataatatatatacaccatataacatatacaaccaaaaactatgacatcatcgcaccacagaagatataaaatttgataatctaatccttcggatcagcttgaacagtagagtgatagcgacgagcaaatgaagatggcctagaggaggatggctgactaggaggaggctgactaggagaaagctgactagattgatcacttgaaaaatttgaaataagaatattcatctattagtcgatccgagcaatattctgtaaaactgtagccaatccagtagaaagaatattttatctttctattccattcgattctctctgtatcacagatgtaggcacctacatcttgatccctctaggcgcctacatcctggctcacttttgttgggtcacgggtggatcacgagaactttagatcagatcacaggaactttaggtcatgtcatggcatctggatgctaagcaagtcacaggtgccaagcaagtcacgagtacctataacatgcaagcataagtgcacatcagaacggtgctggttggacattagcgagatgcttagagatgagcgactgtcggtccaattaggcatccacttacatcagtgcacatccatgatgatgattggatattctgaagatcatcttcctctctctatagtaggtcgtcctatagtagggcggctctatttgattacatctgatcatcgaaccacgacctctgatcggattcgatcggatctgaccagaggatgaccgaattcgatcagaagatgagagctggaaggatccagatccgatcggaggatgagagctgggaggatcctatcggaggatgaccggattcgatcggaggatgagagctggaaggatctagatccgatcggaggatgagagctgggaggatccgatcggaggatgaccggattcgactggaggatgagagttgggagtatccagattcgatcgaaggatgagagttgggaggatccgatcgaaggatgatcggatccaatcagaggatgagagctgggagaattcggatctgatcagaggatgagagctgggaggatccgatcggaggacgaccgaaggataagagttgggaggatttagatccgatcgaaagatgaaagctggaaggatccgatcagaggatgatcggatccgatcggaggatgagaattgggaggatccagatccgaccagaggatgagagctgagaggatccgattggaggacgatcgaatctgatcgaaagatgagaggtgggaggatcctcataaaattgccatgtagtagggggctttatgagtcaccttttgatatggtgactcctagagtcgtcatttctggctgattcaacactcccacatggcatgagggcgggttaggtggcacttgatagggcgactttctttcgaacagcatcttcgtaaatattttttgaagaatattattttcataaattattttaaaattaataataaattagtaaaaaatttgatttggactggtataggtcggtacgggacggaacagggatagtatggtttggttttctattttttttgggccattggatggatttttttgaatggaggggggttctaatcaagaaaatgccatttgttatggcgtctttgaaaacaccatttcaaatagtactttcaaaaatgccatttgaaatgacgcttttaaaaatgtcatttgaaatggtgctttcaaaagtgccattacaaatgatgatttttttttttggtcttttgattccacgggagacggggggaggaaatgacgtggagcgaagaaatgctatttcaaatggcattttctatcaaaaaatgtcatttgaaatgatattttatcgttttgcatcatccctgtaaataagttgaaagatgtattagttttgtaaaaaaaaaaattaatattatttaggtaaagaagtccattgattgtcccttgtttacttttggaaataaaaagagatttttggaggcagttataacgagtgaaatctacaggtaaaaaaatccagcaatacgggcgggaaggcttgatattagccgcaaaaagaaatgatgaaagactataattttttagcaaaaaagtgagtaaccctaaataggatatgatctaaatctagaagttagaaagcaagaaactaagtataaaagctagaaaactaaggaaactagatgtaagagctaggcaagatatagtaattaacttctccatcttgctgtcaaaggacttcttgttagataatttatttatttttgcttgaatcgtattctgttattcatgcaaaaatcaaaatcataaataaatcataccttacaccatcgtctcaccaatacgatgatcacatcatccacagaatatctgatcttccttcacaagcaactggtcttctctctcctcaccctccttaacacaaacaatcgatgggaatcatcacaccctcctgagagatggagaaaaggatcaggccacctctatttatacttgcacttgtcttgtcccatcagaagatttaatcctaattaaggttgaacttccagtctaaatcttatcaggaataggattctttaattaattgagctcactgtaattaattcaggacatatggttgatccaaagaattaaatctgacgaagtgatgattaggtcatattaagagtcaaatccaacattctcctacttggcctatattatcacttaaaaataactatttgatttttcaaaaatatattattttaaaaaaatattttaatttttaaaaacaactgtcctgaatcaaaattttgaaattgacctgacgagtgtgcactcatttttaaaatttacccaattatctattccttgaaagatcctttatactttgattaagtaaaaattattaatatagatcatagcggttatacatctcaattgacagtctcttccatgtatcataacatcaataattctcacttaactcagtcttatatattagaatacataagctattaaaaaccataatacctatgataatgatcccactattatgtcatataaatgacacttctgtttactttaatttttgacaaaaatcaagtataatgtatacgaacaataattaaacagaagtaatagcagtcatcaaaccattaagagatcttaaaacaagtacatattacaaattaaatatcctaataacaaatatccataacttttacatgctctttaaaaattttgcacactaaatctttcatcaaaaggtcagttatcatacaagtagtaccaataaaatcaatagatacctgatgactactaattcttttactcatagtaagatacttaacatcaatatgcttatttatattggtcatcttgctactattagagaaagaaactgcagcagaattatcgcaataaattctcaacggcttgaaaatagaatccatgactccgagccttgagataaattttttcaaccatagagtatatgaggaagcctcgtagtaacttatatatttagtttccataatatagcaggcaataatgcactattttgcgctcctccatgaaattactccaccagccaacaggaagatgtaacctgatgtggacttcctactatcgaggcaaccgacataatttatatttgaataactgatcacctccaaccgatcaatcatcttataagtcagcatgtagtctttagtctcttgaagataccgcatcaccttcttggcagcttttcagtggaccatacctagatcactctgatatctactaagtattttcaaagtaaaattgatatcaagatgagtacatacttgagcatacatcagactatgcattgcagatgtataggatatatccttcatctaatttctttcaatctcattctttagatactaaaatttactgaatttatcatccttaataattggcacttcacttgatgagcagcttgacattctaaatctttttaggatcctagtaatataattcttctgagataaacaaaataacctcttattcctatcacgatggatttctataccaaaaacataagaagtatctttcatatcttttatgtcaaaatattcgaaattttttttaattttatacaagagatccaaatcactactggctagtaagatattatccacatatagaactaaaaatataaacttactctccctcatctttagatatatatacattgatcaataatatttttcttaaatttgaaggaagcaatgatataattaaactttaagtatcattacttgaaagctttttatggatttctttaatttacatactagctttttattttcttgcactaaaaatttttcaagctattccatatacacctctttctttaaatctccattcaagaatacagtcttgacatctatttgatgtagctctaaatcaaaataagctactaatatcataatgattctgaatgcttccttttcagaaataaaaaaaaaaattatgataatcaataccttccttttgagtgaatctcattgttataagtctagtcttatattttttgatattatctttgaaatctcatttgatcttaaaaattcatttacaacctacaagcttaaatccttcaagcaattcgacaagttcttaaatttgatttttaatcatggattctatttcatctttcatggcatctaaccaaagcttaaaatcatcactattcaaagtatccttaaatgagattggatcatcttttatctcaatatcataatcacattcttgtaagtaaacaacataatcatctgaaatagtcgatcttctaattctaatagatcatcgtaatatttcagattcagtatcattattatgattatttttaatcggatcaagctcattgatagtctgttcagaaagtgatgtatcaatcacctgttgatgttccataatttcttgttaaatagattcacatggaatatctctaggtgttactataataggaagagatttttttattttttgtaacaccatattatacggttcactacttccactattttcaccatcctcaatgaacctagcagtttcagttttaacaattttagtagtgtgtgatggacaataaaatctaaaattttttgatctttctgaatatcttataaaataataactaatagttttgagatttaattttttttcttgtggattatatagtcgagcctctgcaggacaacctcaaacctgtaaatgccctagacatgattttctaccatccataactcaaaaaaaaaatagaaacgaccttactaagtatccgatttaagatatacatagcgattttcaaggcttctccccatcatactcctcaccatgtccatcaaggtgtgattatgtctttcagccacactattttgttggagattttctgacatagtgtactgtgttacaatgctatgctgttcaaaaaatttggcaaaagatacaggattatggtcagattcatcatacctactatagtattcaccatccctatcagatctcataatcataatttttctatctaattgattttttacttcagctttgtatattttaaagattttcaaagcttcaaatttttcatgcaatagaaaaatataaccacaatgcgagaaatcatcaataaaagtaatgaaatacttttgccactccaaaataagatataaaatagccacaaatatcggtatgtatcaattttaagaatttttgacttctagtggcatgctttttatatcttttaatttatttttttaatacaatcgatgcacataccaaaatcactaaattttagatttgataaagcacatttcttaaccaatctagttatcctttcttttgatatgtgatctaatcgtctatgccataatatttaaaaactttcattcacaataccacgtttcattctaatattgatatttaaaataagtaaagattatttaaaagaagaattcaaattcattttatataatctattgcacaatattcctataacaactaaaataattttttttattaatttaaaacttgaatttataaaagcaaataaaaaacttctaaatcaagtttttataaagaaattaaatttttagatattaaataaatataaaagatatcatatagatctaattggaatccaatatctataataaatctgtaggtcccaactgaaataattttggacttcatccgattctccataaagatccaccactctttattttttggctttcgacttgaaaggaatccctgtattgagttgtaaacatgaatagcagcatccaaatcaatctatcaagtattagaaggaacatcaataaaattaattttgaaacaaataaatgataagagaatatccttcttttcgaactatttctttcttttcttacaatccttcttgatatgtccctccttgttatagaaaaaatattttaatttatgagaatctttctttggtagattgctggaacctttatgctcttttttcaccttctttcttttaggatgctcctgtgaaaccacatgaataattgggaccccttcatgtttcaatcttttttcctcttgcacacactaggagattgagttcattcattgactatgattccttatgtgtattgtaataaattttaaattggataaacttagatggaagagaattgaaaataaattggataaaaaagttttcagatactgtcatacccaaatcattcaatttttcagctatatcatatatttttataatgtgctttcgcactcttgaaaatccgtcatattttatagagattaacttgttcattaagataccagctaagactttacttgatctgataaactattgttctacaaagaaaatatacttagaggccaattcgttatcagaaacagatctcctaatatctctcgctgtgaaactcttaataatcatgaaagataatctattagaatgctctcatttttcacataatttcttatgatcagactaagacttacgaaggaccaaatctaagtctaggcattctaaaacaatgagaagctgctcatgccaatcatgataattcgatccattcaatgtgcgaatgttagataaatgcgatgagagtaaaatgggggtcataactataagtaaaagaatatgctcataattacgatcatgatgcagattttctaacacaattctgctaataacacttattatacaactataaaacatctttgggcaagaatcatagcatataataagaatcataactaatttaattataaatttatatataataaacaatgccaaaacatgcatcacataaattataaccaacaataatatgaaatatgtaagcaagaataataattatggcatgtacatataattcatatttaaactatgatccatcatattagttatatattcagtggtttaactaactacgattacaaaaattctaggttattcccatctttgaatgtagaattctccatctttatgtaattcaagttagctaacctattgctattaattttgtatcaaattacagtaacctttgggtcaactgtaacagatacacctttatgtaattttaaaactataatgagagaaaaaatcatcagccctcaatgactcagttattcaaaatctatagagtgctccgagccctttggggctatgcaaaaatacacttgaatattacaataatgagcaaaattatcaaataaataatatataaattatttaaatattttatcatgtatgagaatagaatcaaatattcttcaagccatcatgagtccaacggttcaaaaaaatgctcaaatcggatataaaacgaataagatacagtaattttaccaaaaagctcaatattagaggattcaatcgtaaatctcagacaaaaaagggacttttctataagataattatttcaaaataagtctgtcagaaaacttcagggatttttctgtaataaactatgtcaggggtttatttgcaaaataattttaaataaagctcagattaacgggtttgggtctgatctgaaaccttaatggatcaaacctaagacccgaaaggctattatgggttcgtatctggatctgttaggacccaaaacccgataacccaaactctcttcttccacccctgatcgtgagaagccctaagggcttcttccacgttgtacgagcggtcgagcgccgcccctatccaccccagccactgaagacaagaagcagggaggggggtggactgccgccctcgtcggagcactgcggaagccctatcgccatggtagaagccatgatttttcatagccacacggagacaccgcgtgcggtggtggctcccactgccgtcggggagcaggagctccccctccgccggcgacccaccgccgtcgttggcatggcagcggccacggtcgctaccccattcgtcggatggcacgggtgggtgtccgcggccatcccaaaacccccctttttttaatatatgtttcaggaaattaaaaaaatattatttaattttttaaatcttattttattttgaaaaatataaaaaaataattttaatattttaaaaataattcataaatttttacatgaatatgaagcatgaaactggggctctgataccacatgttagataatttaattcctttatatctagatcgtactctgatatttatgcaaaaatcaaaatcataagtaaactataccttccgtcgtcatcttgccaatatgatgattacgtagtccacaaagtattcaatctttcttcgctggtggctgatcttctctctcctcatcctcctccttaacacggacgatcgatgataatcattacacccttctgaaagttggagaaaatagatcaggccacctctatttatatctgtacttatcttgttccatgagaagacttaatccaaattagggtgaaactttcgatttaagtcttatcaggagtaggactctttaattaattaggcttactataattgattcatgatatatggctgatccaaagagttaaatctgattaattgataattagatcatattatgaatcaaatccaatatttttatataccaagaaatccaccaattgatgccatgaagtatggcgcaaccatggactccatcaactatggccttatcccccataatctataaaggcttgtgtagaatccatcggacaaggaaaaagaagcaagatagtacacaaaaaataattctcattaacttgtaaaataggggatacataaagagaatccataggctttgagacacctacaagcattacggatgccatagattttaaaaaaaaaatcaaaaattaagttccaagcttctcaaaagattacaaactatgtaattgtcaccgagttggtgattttagaaaaaaagccttttgacaatgtagtaacaattgtcagtattgttaaagatattaatttgtaattctagaacctagtattaattaatagtctttgagaaattcaagagatttgggaattctaaatatcatcttgagaaagtcaagagacacatttatcaggttctagaatattaagagtcattttgtaactcttgagagccacttttgcattcatagtggtcagattcaagagtcattttttgtatctataaataggaggccatagagcccctggtaagatgtgaagcaagagttggagcctttcctatcatatctttcctctctctttcagtagaaagtcatattctttcgcataatctcttgtattctttctagcacccaacaaatttggtattagagccatcttctctcttgcctcatatttgcatactaagccctccaaaatccacaaacaagtcttataagccctatggcagcaagcaccagcaataccaccttcaattatacccaaactttagctcctatctttgaaggagaaaactatgactatggagcatccaaatgaggatgctcttcatatcacaagatctctaggacttggtggaaggagactatgaagaaccagcaagtactccagaagctttcggggcatagaatcaagcaaagcaaaaggagtatagggagtgcaaaaagaagaatgcgaaggccttactcttcatccagcaaggggtaagcaagtccaactttcctagaattatgggtgcaactaaagctaaagatgcatgaaaaatttaaaaaaaggattttcaaggctccgatagaataacttgtatcaagcttcaatctttgtggagggagtttgataatcttgaaatgaagcaaaatgaaattgttacaatatttctttctggagttgcttgtatcatcaatcaaattagaagctatggagatattattccagaatgcaaaattgtctaaaaaattttaagagttgccagctaaatttgagcatgtagttgcagcaattgaagaatcaaaggatttatctcttttctccttgcatgaactaatgggctctcttaaagcacatgaggaaagaatgaacaggttcgcctcttagcttctggagcaagcttttcaagccaagcttacaattgatgcaaagaagagtgagcaagacagcaacaaggagtcttctcaaaggaaagatcaaccaaaaaaaatggaagccaaattttttggaagctcaaggcaaaaagataggcataaacagtaacccaagaaatggtaattccttatcttaatgttttatttgcaagaagtttgggcatgaatcaagaaattatcattttaaatgtacaagatgcaaaattccaaatctttctgagagggattgttagtataaagaataaaaggcaacctaatgaagcaaatttttctaaagaaaattatggtgatcagttgtttttactcttgcatgagtacacaataagaatcacaagatacttgatatctagacattagatgcagcaatcacatgataggaaaccaaaagctctttgtccaactaagccggcttcttctcaaatcaagcttagagatggcaaactataataagttgaaggcagaggtgtggtagcagtttacaccaaaggaggtataaaaaaattaattcatgatgttttatatgtttctggtattgctcaaaatttccttagtattagacaattggtgcaaaatggttatttggtttcttttgagaatggcgaatgcacaattcttgataagaagaaagatattgttattgctaagatcaaaatgacttcaaacaagattttttctcttatcatgtcaactgaccaaaatattgtcttaaaaggagaaaatcttgatgattcttacttatggcatttgagatatgatcagctcaactataaaggcttgaagttgttgaaaaataaaaatatggtaattgggcttccatcaataaacaaagaaagtcacttatgtgaaggttgtgtttatggaaaactgcatcggcttccatttccaagagggcttggaggccacaagctccgctagagctagtgcacgttgatctttatggccttattagaaccccttcttttaatcaaaaaagattttttcttctctttgttgatgattataccaagaagatgtgggtattctttcttgagcaaaagtcagaggcattctctttcttcttccagttcaaagcttttgtagagcggcaaagcaatcatcaaatcaagactctaagaatagatcgtggaggagaattcacctttggaaccttcatgaactactgcaaagagaaaggcatcgagagacaactcactatccgctgcacaccagaataaaatggagttgctaagtgcaagaattacacaattgtagagatggctagatgcatgatgaatgcaaaggcttgccaaataatttttgggttaaagctattaatacagctgtttatatcctaaatagatctccaacaaaagcaatgctgaacaaaactccttatgaagcttggcataggcaaaagcctgaggtaaatcatcttaaagtctttgactgcatagcttattctcttattccatctcaaaatagagataaatttgatcaaaaagaaaaaaagcatatctttattggatatagtgatgagtctaaaggctatcgccttctgaatcctacaaaaaatcaacttattgtttctcgagatgtattctttgatgaacttgtagcataataatgggaggccaatcctcttgaaagtgcaagaagatatgagcttatggagacagaagcaaatcaagagaaaactgagcatcaaccaagcccaatgagagcattaagggaagacatttcaagtcaaatcatcacagattctatttcatcccaaaaaaggtgtgcagcttacatgagatctatgaatcttgtaatgttgccttcttttcatgtgaaccacaggattttaaaaaagcaagaaaagatgagatttggctaaaattcatagatgaagaaataatcactatcgaaagaaattgcacatgggagcttgttgatctctcagaaggcaaagatgttatcaaggtcaaatggatctataagacaaagttcaaaaaaaatgactcaatcgataagcacaaagctcgtctagttgcaaaaggttatactcagcaacctgatatagactttacatggacatttgcatctattgttcgtatagaaatagtgagaatggttcttgctgttgcaattcaaatgaaattgtcggtttaccagcttgatgtaaaatcggcttttctgaatggtgaacttgaagaagaaatttatgtggagcagcctgaaggctatattatacaagaaaaagaaaataagatgtatcggcttcggaaggcattatatggcctaaagcaagctccgcatgcatggaacaccagaattgatggctattttcactaaaattattttcgaaggagccctagcgagacttcattatacataaaattgcaaggtaaggatttcttaatcttttgcttatatgttgatgatttgatctacaccgacatcataatggaagaattcaaaagagcaatgatgaaggaatttgaaatgactgatcttggacttatgcattattttcttggcatccaagttactcagtcgaatgaaaaaatttgcatatcacaatagaagtatattgaagatttgctcaagaagtttcatatgggaaattgcaagccgatggccagtcgtttggctaaaaataagaaatttcaacttcatgatggtgctcaaaaagttgatgccacaacttatagaagtttagttggttcactcatttatgtcacacatacaaagctggatattattttttcgattagtctcttatccagatttatgattcaaccaagcaaacttcattatgcggctacaaaaaggattcttcgttatctacaaggcactaaaagtttgtgcctaaagtatgaaaaagaggaggataacaggttgattagatattttgacagtgattaggctggttcttttgatgatcgcaaaagtacattaggctacatattttgcctaggaacaaaagcaatatcttgatctttcaagaagcaaatggtagtggcactttcatctactgaagtagaatatatttcagctactgatgtagcttgtaaggctgtatggcttaagaggaacttttcagatatttttcatgaagaaaaaagttcgacaattattcggtgtgacaatatgtctgcaatagctatgataaagaatcttgtgtttcataacaggaccaagcatatcgagattcactttcatttcatcagagacttgttgagaaaagagatattcaactagtgtttgtcagcaccaacaagtaacttgcagatgtcttcatcaaggcaatcatgattgaaaagtttcagcaagccagagatactttgggaattacaaattaagagggggtgttaaagatattaatttgtaattctagaatctagtattaattaatagtcttaagaaattcaagaaacttgggaattccaaatgtcatcttaggaaagccaagagacacatttatcaggttctagaacattaagagtcatattgtaactctgagagccatttttgcattcatggtggttagattctagagtcatcttttgtaactataaataggaggcaatagagcccctggtatgatgtgaagcatgagttggggcctttcctatgatatcttccctctatctttcaatagaaagtcatattcttttgcataaatctcttgtattctttctggcacccaacaagtatgtgatgatggttattctaatatcgaaatattctgatggtcacttgttgcactgttggatgctttgccttaggactctaccttggacctagtttaagctacttttgatgtttggttcgagcctgatggcttgcaggaattcaaccctgataaataagaggcttggtgttcctcactggagtctggttcagactttgaaatattctaccatacaccatgatcgattttttttttaaatattattttttaatatttattttcaaatctacccctcttttcatcttatttccaaaaatacaatacttgggctgagtttgcacggatacggtgaaaccacatattgaacatgcgattttgaatataaaactatatgttcaataggcaatttcaagtgacatgacctaccataacaaaaaatttaaaatttaaatttaatttcatttttcaacttgaagtttcaatttttattccaaatgaaatcgcatcttcaagatgcggtttcattccttttttttttggttcctacgggtgcatctcttctttttcatccccgacttcgtaccaaaggacaagcgggggtgggggcttcactgggatcatggagggaaggaggggggcatgcactgggcggctggggcggtggctggatggtgggggtggtgaggtggggtgcgacgcagagagggatactgtcgagtgcgggcgcaggggtcaggagagggcggagtgggttagggggtagttttgtgttcgcggggagcaacaaggggcgtgggtgcaagcttcgtcaggactgggggtttgggggcatcgggcagtgggggctgtagggtgcgggcacaagggtcgagggggggtatggcatgggggagccataggaggtgtgggggatcacggacgaacaataggtgggggggcagcggcaggtgcagcatcgacgacggcggcctgggcctcatggagggagagggaggcggccatggcgatggggagaaatgaacatggggctcgaaaggatggtgcagagaagcgacggctggacggaagtgccgtgggtggcacaccgaagggggagtgggtgcgggtcaaccatcggcaaacgaaggtgaaggatcgatgggggggatgtgggaggaagggaaggaagaaacgaaacgtgtgtatgtatgtatgtatgtatgtatatataataataataataataataataataataataataataaaatatatattatttgattaataataaaatatcattattattagaaataaaaatagaaggtattaataatattattttattataaaaatttatgttgaggatatttttgaaatttagaaatagaaggtatttatgtaatatgatattaatatattaaaattaataaaaatgatatattaataatatattaataaaataaaatttatattgatgaaataatctattaatgcattaataatatgatattttattaaaaattaataaatatatttatcactaaaataaaaattttatataataataaatttgctatctgcgcccattgccgctctgtgcgaacacaaaaccaaccccctaccccacccgctttgccctcctccggcccgtgcccatgccctcttgcatcgcaccccaccaccccttaccgcttggcccccctaccttggtcttggagaagcccacacctgcagctcctgcttgccctttggtatgaagctgggaatgaaagaaaagagatgcaggaacaaaaaaaagaatgaaatcgcatcttgaacatgcaatttcagtaaaatcgcatgttcaacatgcgatttaaattttaaatttaaaaataaatttaaattttaaatctttgattgtaatgggcacgtcaaataataatatttttattaatcaaataataatattttattattaatatattattaatatattatttttattatttttaatacattaatatcatattacataaataccttctatttctaaattacaaaaaaagatcctcaacataaatttttataataaaataatattattataccttctatttctatttctaataataatgatattttattattaatcaaataatactttattattaagtaaataataatattttattattaatcaaataataatattttattattattattattattattattattattattattattattatatattttttgtttctccctttccttcctcccactccctcccacccctccgctggtcctccaccttcatctgtcggcggtcaacccgcacccacccccctctagcacaccatctgtgactcctccgcctggccattgctcctctgcattgtccttttgggctccacatctatttctctttgctgccatggccgtctctctctcccctcgcaagatccaaactgctgccgtcggtgccgcacccaccacggccccccccactcattgttcgtctatggcccccttgcccctacgattccctcgcaccgcaacccccactcaacccctgcgcctgcaccttacagcccccggcacccccatcccctctaccccctccaaccctggcgaagtccgcacccccctcccccgctctgcgcgaatgcaaatccccccaatcccctccgctctcctccggccctgcacccgcacccccgaccccgtgctgcactctactgcccctgtagcccagcacccccttcccttcttggtcccgacgaagcccccatccctgcttgtcctttagtgcgaagtcagagatgaaaagcaaaaaaaaaaaaaaaaaaaaaaaaaaaaaagaagatgcactcctagaaatgaaaagaaaaaaaaatattttgaataaaaattaaaactgtatattcaatatatggttttagttttaaatttaaaataaattttaaattttaaattttttgttatggtagatcatgttttttgaaattgcatgttaaatttgaaatcacatattaaaccacaatacgtggtttcgtcgtgtccctatcaactcactccaagtagcgtatttttgaaaaaaaaatagaaagagagcagatttgaaaataaatattaaaaaaataatatttttagaaaaaatccctccgtgacctctaatgctcacataaggccttctacttcctgtcagcatgatctcatcatcaaggatggccttgacttcttacccttttttttttttgggcgtcatcagtgctggaacggtgttacgtctttgtgaggcggcaattgtatgtggacttccatgggcatgtttgttttttttttttgatgcaagacttctacggtcttgtttggctgtatatgtagcacattatgacttgtgagaggcgcggagcgagggtaagaagttctgtcacggtagagccttgatggtgacgtgctcgtaaaccagcaccttacttttattaattatatcaaatggacttcatataaaaattttgcttaattattgatttttcaagcaaatatcatttttttgtaaaaataatagacatttaagggacatcaagtgattctattctttgatttaagctaagctaaatattggatatttggaatatgtataatgattgttcaatggatatgtattagatttcttagacttcgtagcaaaatagtccatgaatattagccattatacttcatccaaaaaaaaaaagaacagccgttatacaatatttgaatatcatataatgattgctcaatttttgatcttctcctaattattttgatgcatcaagtgtatgtgtccccttgtctaacttacgtgtccttatatatacatatatctactaacatcactcaagttaccgaatggcttcttatttattagataaatgccttgttccaataattttgtccatttatcattgatgtagagatatagagaatggacaataattatatattatagctaactttatattggtcaaaatatcacgatatttatgctcgttgtttgcttgcaagactttttctcttttcccatctgccaccgagacgcatctcttgcaacggagaaataatgattaggcaaagggcgagctagaatggtcaaaaggattacaaagactccattttctcgcaccaaattggttatccaagagaggtgtttaatccccatatttagcccctatcacttacaggtggcagtttcagggcctcccctgcatcctatcttttatgtacaggcttaaatggaaaggtccttaattatttatgtaaaaaagagaaaaataagaaaaagggtcattatctttcataaattgaacccaaattttgtatcagcaaggcttcacaaatgtgtcgtccacatgttacaatccggacttaatcatagcggtagttattattaaattgtgattcaaagactaacagcagctgttgcagcatcactattccattttgacaaaaaaaaaaaaaactcaatcaaagattcgggtggccaaagtagggccattatcttaggtacaactgagaatgatggttttggaggggttgaaacctactgctctttagcatataattaatcgccaacctaccttcaagagaaaacataatggctaacttcagatccctagcacaagctacggttagtacaatattatctgccgccactttgtaggatttctagttggattaactggtcaataaaatcaaacaaaatggaattgtgggaacgagatgttattaaaaattagaaacattcataatgatcagataagtttccatgctttgctgcccatggcttgctaaaaccagggaggttgagcttgggatggtagcttcacagtttcaaagttaatacatcacacgctttacaaaaagaaaaatttttgtggctgataaataatcctagcttttttttttttttaattaccgcgccaacggaagctccatacttccacgcattctgttcccctgttttgggggtgtgggttccctctccatcaccatcaaaaacaaatttccactacatttctgcatgaaaagatccaagcatttacagagaccaacccgttgggagatggtctgcagcatgagtaagaactagagagaagtctgtatttctgtgttgttctcttcacccttctattatctctggacttttctgttattctgccacgaattgcaaggcatagtaacagaagtatattttcaaagcttcactatgtttattgagacttggcatgcactacaagtattgtacaagtgacttggactatatataggtccaagtttttttttttgctctttcataggtgaaatagatcaagttcacaatgtatttatcctatccggtaattctaaggttttgcacatcaaataaccataccgtgctactgaatcttaatttcgataattttataactcaaatgatcataaacaacttggtggcacaacaaaaccagagacagtgccatcagcatgactacaaaatgattttgcttgttggtccccataggtgagcttgatgtcttgcagttcaattccattacatggattgcttgcactgcagtcaaagttcatagccacttgtgatgcagatgatccttggatatcactgtatgtcacttgacttatcttcacgccagaattctattcaaaacaaaagaaaatgaaagcttgaaaattcatagtaaaacaaacttctaattttaattgaaaaattatttttacaagttcctgcacctagctcttgttatagtctactcaatcttggtcgatgacccattacgccctaaggtctgatgcatgatgaatagccttgtaagctaacttgaagcccaaccaggaaatcatcaacaacagcgcaacccaagtataaaattgggctttactaacttggcccatttcactgctttagtctcccttcagtgctgtttttgtctactttaggagactcgactcatggatatgagtggtgagttggttttagcccaaaagatgatataggttgccactcactcgcatgggcttgggttgtatccttcacatgaaagaactgctagatctcaaagcaatccgaacttctttattcatctagttacatagatctcgaagtgaccattaattgtgcatagattcatgcataaagaaagtaatgctgtatgaccaaatctggtggggattaccatcgtacgtgaaattggtgcaattcaccggttgggtcttggtgcaaagcaccatcactgttttatgacgtcaggccttgaaacaaatactcaagaccaaggttgatcccaaagaatttttgacgcaaaaattcctcgtacaagtacgtatatatggtgattttttctccgcttcactaattcatgtgaatcacaccagcccaacctcaggatcgcaccaactttttcatgccgtgcaaaaaaatttttattagttttgccgttatactatcacgtatttttttattcacgttattctcgcacatgaatagtggaagacgaagggtggtgggataggttagccgccccaccccaatatgacgcatttacccctgcaaatgaacttaatttcattacctggtcagggcatccactctggccggggcagtaattctggtcaatgatgatgggattttggacattttgcatcgtagcgtgttcgaacgccactcccttcacgaacccttcgctcggcttcccccacgtctttatccgcagcccgttctgcgttcccgtgaacaccgtcgtcttcaccgtcacgttctccaccccctcctcgtcgtactccttccccaggctcccaatgctgccagccaccaacatcgcacgtgtcagactttcacacgtgtggaacaaaagtaattttgatgatcctgcttgcatacatgcatgacatgcaaaatgtgtgcgtgcaccatgcaacatgtaatgcaatacatgcatgttcccttgattacctgatgccatggccaggaccgcaggtgacctgctcgatccatatattcatggtgccggggccgatcgagatgcaatcatcgccggtcttgatgccggccccagtaatcgtgacgtcggtggatccctggacatggatgccgtcggtgtttggactgtttctcggagctgtgatcttgacaccttgcaaagtcaccccttggcagtcatcgatcacaatgtggaacatctcgctgttaatcgatgacagcccactgatcataatgttcttcgagccatggaaggctaatgactgtataaagaaatggtaaattgaggttatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataatttattattaatttttaaataaaatatataaaaataaataaaaaaatatatatatacaaaaatattataaaaatatcaataaatatttaattttatgtataaataaagctaagtaaaaaatattaccttacgtcatttgcaaaatgattttgattgtgtaaaaatctcaataatctcttccatattaaagattaaagaataaataaggagttaaaaaataaattaataattatttttttaaaaaaatattatttttaataaaaattaatatattaatttattatatggtcttttttcaaattggtggactcgtaatgtacataagactaaaatattggaggggccactatatatataaatatatagataatattttttttgggtggagaattctttcagttgactgcgtcaccattgcatgcgaatacatatcctgatgtatattttcaatcatcaagataaaatatgaagtttgaatcagtatacccctcgactcgcaactctgaagctcttccaaagatcagaaataaatttttaattcttttcaaatatttaaggacgttcttcacaattattctgtacagtaaattttttttttttgtatcgatagctcaggaagctgagaaagccattgcccaatttctggattccttcattcaacagtacttccacgtacttttcccgtaaagaggaaaaaaaaaaagaccttttatttggtgcctcaccaaatggattaatgtgcagtagacactctttttgaaatcacttttgagtgcacgaagaataccaagtatacaactggtagcgtatttcgtagctggtaattccgtctattctcgtgccacatgtttccacatagtgagaaatatcaatgggcatccttgggttgggtattgagtacatcaaccataataaacacatgcggtgcaaagaatagtaggagagatccgggttgttcttaccacttttaggacacagttttggcgtgccaataggcttcaaaactcctagtgtcctacggcttatgtagtatgtatgctgttttttgtgattagtgaggcgttaatgaacggcctgatgttcacttttattataatcaaccaattaaagctaacttgagccaggtaatttggttatatttctccaaagaataaaaagaaaagaaaaagacgagaggagaaaggagaacatcttgcttctcatttggggggcctacaccccaacaagggaaaaagaaagaactgaagacaaaactagagcaatgggaactgaattgcggctaattaatgctgaatgaataaaaagacagttcggtggacaataatctagtttcagttacttgcaggttttcctctgcagacttatcataagaacttttgaaaatattgtcttgtcatataaacttgcattccgtcctcctgaaggaacttgctaacaactcatgaagaccaccgagtcaccctttcaagggaccaaacgcaagaatcaagcccctccttccctactaaacttggataacagccatataagagctctaaatgacaaaaaacaacattctcacgcctcgcttacttccttttcctgccaccagatcagaaccatcccctgatcctataaataccaactccctgagaccatctggctccatccaagtccctccaaacccactcatacctatatctcataatctccttcctttaagaccttctatactttcataaaaaaaaaggagtccaatgactcaaatcatgtgctccttccgcctcctcctcctagcaattctcatgatccatttctcctcatcagtaaaagcatcttacgacgttacttcctttggtgccaaacccaatggtcggacagactcgaccaaatcattcattagtgcatggactgccgcctgtcactcaacaaaccctgcaaccatccatgtaccctccggcttcttcctgataggtccggtcaccttcaatggtccttgtaggagcagtaggatcaccatccagatcgacggaaccctcgtcgcaccatcgaattatgctaatcttcgcaatcttgaacagtggattttgttcgatcatgtcgacggcatctcggtgtacggtgggaccatcgacggccatggctcacctctatgggcctgcaaggccgccggccggaactgccctgccggtgcaagggtaggtggcataacactacgaaatgacccatttaccctcacaactttttttattcttggcactaactgctgttctacgtacgcagtaaattgagctgaccatatattatattgtgctcctctccatgcagtcgttagtgttcaggaactcgaagaacatcttgatcagtggactgacgtcgatcaatagcgagaggttccacatcgtgatcgatggctgccaggtggtgacggtgcacggggtcaggatcacggcccccggcaacagccccaacaccgatggcatccacgtccagtcctccaccgacgtcacgatcaccggagccggcatcaagacgggcgacgactgcatctcgatcgggcccggcacgacgaacctatggatcgagaaggtcacttgtggacctggccatggcataaggttaggaaacgttacaccaacagcacgtgaaacgtacgttaaatttgagtttgacacgtataagatgcttacgttggaacactcacacgtgtgatgctggtggctggcagcattgggagcttggggaatgagtacgaggagaagggggtggagaacgtaacggtgaagacggcggtgttcacgggaacggagaacgggctgaggataaagacgtgggggaggccgagcgaggggttcgtgaagggagtggtgttcgagcacgccatgatgcagaatgtccgaaatcccatcatcattgaccaaaattactgcccccatgagaaaagatgccctggccaggtaaagaaattaaatccaaatccaagggtaaacttgtctcgtaataacggttaacgtattctatcattgtctctgcacaggatatcacgttcggtattctcatgaacttcaaatggtttcttttgctagagaccaaagtttacatgggattgcaaatttaaactttaatttctgaatggatagattttttaatgttgaaactttcttttttgttctctctctgtttgtagaattctggagtgaagattagtcaggtgaactatatggatgtccaagggtcatctgcatcacaagtggggataaactttgactgtagtgccagcaacccatgcaccggaattggactgcaagacatcaagcttacctacggaaacaagccagcaaaatcgttttgtgagcatgtccatggtactgcctctggttctgttgtgccaagttgcttctgactcttcgagttggaatagtatgtatagatcgtatgtcagagtatgcatgtgttgatgaaatgggtgatgtaggattcgtaacttttcttatcctccatgtccaagcgttactctagtagacatggaatggaataaatatttaatggattgatatgtgttttttatttataataatttcggcctaaactaacgttctcattcatggtccccattaacttcggaattaatattcgtggtgcccaaaaagtcctcaagagtgggcccagcttgggtctcaaccttttccctggaattacaaaggctcaaatttctaataaggcacgaatttcagaagtcagatcaaagcaacggagaccctaaaaacgaacgtaccccatccgtacgttgttgtttcagagaaacgaaaattaagttcgaaattttgtcctacactcaaaaacaagccctgcaaatccgaaagaacgcggtaccacgtgaaaatcctgttaacttcttaccgcttattgttgctgtagatttctctgattagaaatacaatcatctaatcagaaagaaatatgtttgtataatttttaaattgaatctctctaattaggaatgcaatcgtctaattagagaaaaatatatttgtataatttctaaattgaatccctctgcttaggaatgcaatcgtctaattagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatagtatatatatatatatatatatatatatatatatatatatatatatatatataaatgctatagctatacatacatacatacatataatccgtaagtgtacatataaatacccacgaaaacatccaggcaacctctccatttattcgtagtaccgtctcatggctcaactaatccatttatttcttctcctcctagtatcctcctcccactaccactcatcagaggaagcagctaatcaccataacatcatcgactacggcgctaaaccagatggcgagacggattcgaccaaatcattccttggtgcatgggacgccgcctgcggctcgccgggacctgcgaccatcctggtgcccgccggcttcttcatggtggatcacgtcactttctacggtccctgcaagagcagctacatcactgtccagatcgacggcacccttgttgcaccaaccgattacgccaactttggaaagaccaagcaatggatgatgtttaatggagtccagggtctctctgtgtccggcgggaccatcgatggccggggcaagtctctctgggcctgcaagaattccgacggggactgccccgacggttcaaccgtacgtttcctcgggcggtccttcatttgatccttatttctttcctattgtaatttattctccgtcttaactcatatgataacgtaattcgtcatttaatttcttcatgcagtcgttaacgttccggaagtcaaagaacgtaacgatcagtgggttgaggtcgatgaacagcgagatcgaagactgcgagggggtgacggtgcaaggcgtcaagatcgaggctccggaggacagccctcgcaccgacggcatccacgtccacaagtccaccggcatggcgattatccggtccgatatcgggaccggcgatgattgcgtctcggtcggccccgacacgacaggcctgtggatcgagcaggtcacctgcgggcccggccacagcataaggttcccgcgaaagatacacgtacgtacgtttgcatggtgcgggtaaaccattgcatgtcgtgtatgtgagtaggatcaacaaaattaactgtgtttgacacgtgtgggagtcttttagatgttgtttagtgcctgcatgtgattgctggtccgtggcttgcggcatggcagcctggggaaggagcatgaggagaagggggtggaggacgtggcggtgaagatggcggtgttgaccgagacgacgaacgggatgcggataaagacgtggggcaggccgagcacggcattcgtcaacaatgtgtcgttccaaaacgtcacaatgcaaaatgtcaaacgtcccatcaatttgatcaaaattactgtccccaccacgagggatgccctggcaaggtaattcaattcagtctcattccaggggcgggggtaacatatctcgttaaattttgcaccatagaggccatgtgaccttgaatgcaggactagcatgcagtgaattctacttaaataatgataaaaaaaataattaataaaatatattaataataaataattatatatatatattaaaaaaattattttgatcatttaatcagagagaacagaaaagaaaggatgctatcagtgatgatgagtagaatcggccttgatattttttagatatgagatcaaataaaaaaataagatcttctcaattaaaaattaatatattttaaatattaattattattaaaaaattaatctatgtgcaataattttttatagatatgttcgttaagcagcatataaaattcatcattaatctatttaattatttttttattataatattataaaaaaatatttttgtatctcactgaaacattaatgcaggtctgggacctagggcgatcacccaattcgacctatcccaaggtcgttcctgaagacgaggaggtatgactgctgtagcttcagtattttattttgaaaaaaataaaataaaattcaatcaaagattaggatggccaaattagggtcattatcttagatacaaccgagaatgatgattttaaaggggtttggatggacggatatcaaaggttgaaagctattgctctttagcatataattaatggctaacgtaccttcaaggaagaaaaaataatggctaacctcatgtccctagcacaaactatggtaagtatgatattatctgtagttaatagaattagacaaaataaaattgtgagaatgacatgttatttgagattggacacatgtttatgatgattaggtaagtctttgagctttgctgcccatgacttgctaaatctaggacttgctttagatgatctaaatcaacaatgtttgggtagagcacaaacttagaaaacctacttccagttggttgtgggctgaagtagcctcacagtccgatagttaatatacgtcacaaattttatcaagaagaaaaattttggtggctgataatttaacataatatccatacagtatcatagaattttttttctttttcgagaaccgtgctaacggaagctccatacttctatacattttattcctctgtttttgggggtttgggttccttctccatcaccatttcggtatgattcgagcatgagaaaacccaagcatttatagggaccagcctgttgggagatggcatggtctgcaacatgagtaagagttatggagagaaatccatttttgtgtctttctctccaaccttctattatctttagacttttctatttattgaatccgattattttgtcacaaattgcaaggcatagtaacaaaagtacattttctaaacttcattatattttttttttgatacaaaaagcttcactatgtttattgagacttggcatgcactgcaagtactgtacaagtgattgagactatggatagctccaagtttttttttttcctctcatagttgaagtagagcaagttcgcaatatatttatcctatttgataattctaagattttgcatatcaaataactatactgtgccactgagtcttaatttcgataattttatgactcaagtgatcataaataactcgatggcacaacaaaatcagaggctgtgccatcagcatgactacaagaagattttgcttgctggtctccatagatgagcttgatgtcttgcagctcaatttcactgcatggattgctttcactgcagtcaaagttcatgaccacttgtgatgcagatgaattctatcgaaaacaaaagaaaatgaaagctcaaaaattcatagcaaaaaaatttttcaattttaattgaaaaattatttttacaagttccagcatctagctctcgttatagtctactcaatcttggtcaatgacccatcacgccctacggtccaatgcatgatgagtagccttgtaagctaagctgaagcccaatcatgaaatgatggacaacagcacaaccaaagtacaaaattgggttttactgacttggccagtgctttactctgtcttcagtgctggttttatctacttcaggagaggcctcagactcaactcatggatatgagcggtgagttggttttaagcccaaaagatgacataggttgccactgactcgcatgggcttggattgtatctttcgcatgaaagaactgctagatctcgaagcaatccgatcttctttattcaattattgatatagatcttgaagcgaccattgtgcaatccaacgatggcttcatgcataaagaaagtaatgctacatgaccaaatctggtggggactgccatcgtacatgaaattggtgcaattcaccggttgggtcttggtgcgaagcaccatcacttttatgacatctggccttgaaacaaatactcaagaccaaggttggtcccaaagaatttttgacgcaggaattcctcgtacaagtatgcatagtgatcttttctccgtttcactaattcatgtgaatcacacctgcccaacctcagcatcgcatcaactttttcatgccgtgcaaaatatttttcaggattagtttcgactggtgtcctaatcaacgtaaaagaaaaccgttatcctatcacgtatttttttattcacgttattctcgcacatgaatagtggaagacgaaggatggtgggataggttagccgccccaccccaatatgacgcatttctccctgcaaatgaacttaatttcattacctggtcagggcatccactctggccgggccagtaactctggtcaatgattatgggattttggacattttgcatcgtagcgtgttcgaacaccacacccttcacgaacccttcgctcggctttccccacgcctttttccgcagcccgttctgcgttcccgtgaacaccgtcgtcttcaccgtcacgttctccaccccctcctcgtcgtactccttccccaggctcccaatgctgccagccaccaacatcgcacgtgtcagacttccacacgtgtagaacaaaagtaaattctatgatcctacttacctgcatgcatgacatgcaaaaggtgcatgtgcgtgccccatgcaacatgtaatgcaacacatacatgttcccttacatgatgccatggccaggaccgcaggtgacctgctcgatccatatgttcgtcgtgccggggccgatcgagatgcagtcatcgccggtcttgatgccggccccagtaattgtgacgtcggtggatccctggacatggatgccgtcggtatttggactgttttccggagcgatggtcttgacaccttgtaccatcactctctgacagtcatcgatcacaatgtggaacatctcgctgttgatcgacgacagcccacttatcatgatgttcttcaagccatggaaggctaacgactgcatgaagaaatgatgaattaaagttatcgcataattaagttaaaacattgatgcgaagatggcaagaacaaaagaaaaaggtcattccacgacgctagcgtgggaataatcattcaaaatacttaaaatttactatcgttacttatatgattttaagatgattttataaaaaaataaaataataaaataaaaaaaaaaattgagaagatattatctgaatcaaaacaccatcctaaaatgcgattcaacctgatcatcctctgacgaaaacaattgttggagaggcaaatgcaatatatttttttcagatgttcaattagaaaaaaaaataaaaaaagaaaaactatgaattttaaaatagctagatgcagagtctatagatactgtccgaattatcaaagaggtgtcgtagttccaaagagataaatattttaaaaataatatatttttttgaaaactaatgttttctgaatagtcatcccttcggaatggagtgttaaataaaaaaattaatttttaaataactaaaatttagaaatatatatatatatataactccaacagctagtactgaccgttgcaccatctgggcagtccacaccaccagccttgcaggcccagagaaactttccgcggccatcgatggtcccgccatacgccgagacaccctcaactttctcaaacgccatccactccccagcctttgcaagatggtgcaacgatggtcccgtcgatctggatggtgatcttgctgctcttacagggaccactgaaggtgatgggacccactaagaagaagccatcaggtatgtggatggttgcagcctccggcgagccacaggcggcatcccatgccctaaggaacggcttgttgaacgtatataagtgggtgattcaaagtgtactaaaatttaggaacgtggtctttatgcatatcttccatgatctacttagttacttagttgagttagtagctgatacgtgaccgagtgtgaaggcccatgacttgtagtggggtgttagttagtaatggatgggaacgtctgttaccatgaatgtctataaaaaaaaagtactgtattgaagtctttgacaaggcattaatgaagtttttgttctacaaaaactgtgttaactccgattcattgcttgtgtagtgttctcatcgcaatgaactaattccaccctcctcttcctttttgttttttttcccgatatttttggtatcagagcagccaggttctgattacgtgtgggcaaagaaaagataagtgattggagttgttgcagcttgaagacttgtaagtcaaattcatggctaatattgttgtgaggaggtaagctgttgggtagcaacatggcagcctttggaagttccgtaagtatttctcaactctcaattcctatctttaaaggtgaatgttaggaattttagaacattaaaatgaagactttatttctatcacaagacctttaggatttggttgagaatggatatgctgatccagatgaagaagcaaagttaagagaaaacagaaagaaggatttcaaggcactgtttttcattcaacaagcagttcatgagtccatcttctcaagaatcgctgctgcaactactgtaaaagaagcttggacaatattgctaaaagagttttaggggtcgtcaaaggtaattattgtgaaacttcagtctcttcgtcgggattttgaaattttattcatgagaaacaatgaatcgctgcaagaatttttatccagagttacatctattgttagccaaatgaaatcgtatggtgaaaaaatttctaaagaattagtagttgcaaaagttttgagaagcttaactccaaaatatgatcatattgctgctgctattgagaaatttaaggacttatctgttttttcatttaatgaattagagggttctttgcaagctcataatgctagaatgaacagatcaactgagaaagtcgaagagaaggcatttcagttgaagggggagacctctacactcaaagataaatccgatagagtcacaggaagaggtcgtggccgaggtggattctgtggccgaggtcgaagtcaaggctgaggctgtgggcaatttgatgatcaccgacaatcatccaatgagtatcgagacaaccggaatagaatccaatgccatcattgcaagaaatttgggcatgtagaggcaaattgttggaacaaagaaaagtatgtcagttatgcagaagaaaaagaagaagaaagtaagttattcatggcttgttatcatattaatgatgaattaaatgagaagttgaggtttgaagatggtacaaaaatgataaatgcaaatttgtttagaagtttggttggtggcctgatttatttgatacatactggatcggatatcgcattttctattggtgttgtttccagatttatgcataatccaaccaagcatcattttggagccgctaagtgaatattatgctacatcgccggaacaatgaattatgaaatttggtattcacatataactaattttaacttgtttggattttcagacagtaattgggcaagttctgtagatgataggaggagcacttctagcaatatgtttatttttggatcgggagctattttgtagaattcaaagaagcaagcaataacggccttatcatcttctgaaatagagtatgtggctgaagcattttcagcttgtcaagctttatagctgagaaggctatttgaagatctttgtcaatttcaaaaaagaactactaatataatgtacgacaatcaagcagcaatagcaatgacaaagaatccaagttttcatgaaagaacaaagcacatcgacattcgacatcattttattcgtgacttggtagctaaaagactggtagagttgaagtaatgtaatacacatgaacaagttgcaaatatttttactaagtcacttccttataacaagcatttctacttcagatcactccttggtgtttgcaactttgaatcaagggagagtgttaagcgtatgtaagtgggtgattcaaagtgcactaaaattatgaatgacttgtagtggggcattagttagtaatggacggaatgtctgttaccatgaatgtctataaaaaaaaaaggtactgtattgaagtctttgacaaggcattaatgaagttttcgttctacaaaaattgtgttaattctggttcattgcttgtgcagtgttgtcatcgcagagaactaattccaccctcctctttcttttgttttttcctaacacgacttgctcgaatccatctcaccatccggtctagcgccgaagtctgtgacgtcgtagactgcatttactgatgagaacaactggatgaagaggagtatcacaacaagaagcaaagaattgatgatgagtttcgccatgagaaggactccagtatatgatcagtctatgaaggaagttattagactgagggagtagagagatgtttgaagggagatggatggtgtcttgttgcttggtggatgtttatatgtagaatatcttgggaggtttttgtggctgcgagaagaagcaagcatccccgagatttaagacatggagaagtgggaaaatcccttctttattccacagtttttgtagaataatggaactcaaccagtccttgaagtcccatgaaggaaacggaacgcaattgtatagtgataaaaagagttctgaaggcacgggtgttggatggatgtctggccaggataccacctcccaagatcctttcagtaccacgcgatgcagcaggaagaaagaaaaaacaaaacaaaaagaaaaacaatcaaaatacgtggatcagtcacaaaagagctcgcctccacggggcatgcaaacttcactatgaaaaagaaattttacaagaggagacctcaccctcaacccttgtatacccaattctctctcacctgaagttctcctcacaaaagctctctctctcttggagaccacctgaacccctgaagagcctggcgaccgctgtcaaggagcctcctgctccttctctcacagcgctctcgtctctctctcttctcggattcgtacggcgcgagaaaaccaaccacctcccctctctgttatcgatcagccctatttaaagggttaaacaaggtttaaaacttaattagagaaggattaggagtcataaacaaagccagatagcccctggaccgtcggatcaagatcgggagccacccacgctctcagatcgcgcttcgatccacggaatagtgccgtggaccgcgagaaatgcgtgggaaacgcccacgcggtttacaggcccagctgtggaccgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatacctccagattaatacgacttgtttacgacccgtgaatatgaattgtcagccctataatagcctatgtatgctgatttttgtgattactggggctttgggtgaacggacctgatgttcacttttattctagtcaaccaaagcaaacttgagccgggttttggatatatttctccaaagaataaaattataaaagaaacgaaaaggagagggggaaaagagagaacctctagtttctcatttggggaaaaggagaggaggaaaagagacgaaaaggaggggggaaaagagaaaacccctagtttctcatttggggcctaccgcctacgccccaataacagaaaaagatagaactgaaaacgaaactagagacgtgggaactgaattgcaaccaatgctgaaaaaaaagacagttcggtggacaagattctagtttcagttacttgcaggtcctcctctctagccttatcatacaaacttttgaaaatatagccttatcatagaaacttgcattcggtccgcctgaaggaccctgcataacaactcataaagacaaccgagtcaccctttcaagggaccaaacgcaagaatcaagcccctccttccctactaaacttggataacagagctttaaataacaaaaaacaactttctcactcctctctctctctctatctctctcttatattagggcaaagcttacttccttttccagccaccagaacagaaccatccactggtcctataaataccaactcccccagaacacctggttccatccaagttcctccaaaccccctcataccgacatctcataatttccttcctttaagaccttctatactttgataaaaaacaaaaaggagtccaatgactcaaaacatgcactccttgctcctcctcctcctcctaccaactctcatccatttctcctcatcagtaaaagcatcttacgacgttacttcctttggtgccaaatccgatggtcggacagactccaccaaatcattcattagtgcatggaccgccgcctgtcactcaacaaaccctgcaaccatccatgtcccctctggctttttcctgataggtccggtcaccttcaatggtccctgtaggagcactaggctcaccatacagatcgacggaaccctcgtcgcaccatcgaattatgctaatcttcgcaagcttgaacagtggattttgttcgatcatgtcaacggcgtctcggtgtatggtgggaccatcgacggccatggctcccctttatgggcctgcaaggctgccggacggaactgccctaccggcgcaacggtaggtggtaacactatgaaatgacccatttaccctcacagcttttttattgttgccactgactgctgttctacgtacatagtaaattgagctgaccatatgttatattgtgctcctctccatgcagtcgttagtgttcaggaactcgaagaacatcctgatcagtggactgacgtcgatcaatagcgagaggttccacatcgtgttcgatggctgccaggcggtgacggcgcaaggggtcaggatcacggcacccggcagcagccccaacactgacggcatccacgtccagtcttccaccgacgtcacgatcaccggagccggcatcaagaccggtgacgactgcatctcgatcgggcctggcacgacgaacctatggatcgagaaggtcacttgcggacctggccatggcataaggttaggaaacgttacaccagcaccacatggaacgttaaatttgagtttcacgcgtataagatgcttacgttggaacactcacacgtgtgatgttgcatgttggtggctggcagcattgggagcttggggaagcagtatgaagagaagggggtggagaacgtaacggtgaagacggcggtgttcacgggaacggagaacgggctgaggataaagacgtgggggaggccgagcgaggggttcgtgaagggagtggtgttcgagcacgccatgatgcagaatgtccgaaatcccatcatcatcgaccaaaattactgccccgatgagaaaagatgccctggccaggtaaagaaattaaatccaaatccaagggtatacaaaacttgtctcgtaataacggttaacgtatagaataacgtattctatcatgttcggtattctcatgaacataacggtttcttttgctagagaacaaaagtttatgtgggattgccacttaggctaattatcttccttgtgaaactttaatttctgtattgatagattttttgatgtttatactttttgtgttctctctttatttgtagaattctggagtgaagattagtcaggtgaaatatatggatgtccaagggtcatccgcatcgcaagtggggataaactttgattgtagtgccagcaatccatgcagcggaattgggctgcaagacataaagcttacctacggaaacaagccagcaaaatcgttttgtgagcatgtccatgttactgcctctagttctgttgtgccgagttgcttctgacttttcgagttggaatagtatgtaatcgtatgtatatcagagtatgtgttgatgaaatggttgatgtaggatttgtaacttttcttatcctccatgtccaagcgttactctagtagacatggactggaataaatatttaatggatcgatatgtcttttttattgataataatttcggccttaaccaacgttctcattcatggtcccaattaacgacgcaatattcgtccagtgcccaaaaagtcctcaagggtgggcgcagcttgggtctgaaccttttcccaggaattacaaagtctcaaatttctaataaggcacgtttttaagaagtcagatcaaagcaatggagaacctaaaaacgagccccatccattgttctttaagagagacgaaaacttagttcaaaattttggcctacactcaaaaacaagccctgcaaaccgaaagaacgcagtaccacgtgaaagtcctgttaactacttaccatttattttcgaaggttccttcgtaagccagttttgtttacctcgcaactctcccgaggttgctgctgtccagaattcgactagggtggcaatttgctcccagctccatctcgactctaatagaatgggttttagtacccaacctgcagcggatccggatagatgttggtaatgataaaatccatcttcaaatcctatccgtgtgtgtatatatatatatatatatatgtagtcttttcacaaattccttcctcaccatttgatttatttattttaattgtgagaaagattgaacgtatgaagagatatgctatgatgcttagttattcattatttagttgatttcttttttagtttaagggatatttgactttttcttaaaaaaataatatttctgtttgttatgttttttattttggtttgttatattttgagttctatctttggctcttattttaatgttatgtgaagtactaagtattatttttatatttttttatttatttgctgcttggctccattttgtttcaagatgagtactgaatggatatagataatggcctatctaacatgttgccatccctaaatataaaaaagagagaccagtggatcatcattacatcaaggaaaatagctatttaagacagttacatgcacaaaatagccacaaaataaaccaaaaaaataggcatcaaacgaggcttgttgagaagaagagaggaaagttgaactgcaagccttcttgccatccattatctataaggaaatttgtacattagaagcaatgtttgaaatatgcctaaaaaaaggagagaccaaggacacagatgctttctgtacaactctttgataaataaatatgctctcaaattaaatgcacgaccattgttccaaattaagtagaataaaatattttaatccatttgttccattttaattcaccaaatactagacagtaaccaatatatcccaaagatgaggtaaatattttgaaagattagtataactactttctggacataatctcgagtaaactatatattctatgcgctttagtttaaaatcaattaggttaaagtaagttaatcaatttattttggattaattaattctacaatatttgtgctgcatcacagtacaaagacaacacaagtcatggccaacacttgggcgtcaagagaatggttgtatataggcttcttttaaaaaatgtccccttatgaatttagcaaggagcttacatgaatcttccttatatattttatatgtagaaaatgggcatctatagaatgtggcaaggagggtggaaattttttcattgacctctttctctagcttaatttagggtgcgtttggttagccattaaaaaaatattttttttactttttaattttaaaaaataaaaatcaaaaagcaatatttgataacatcatgaaaagtaaaaaatcaaaatcaaaataatcaaaataattgctttatatgcaaagcaaaaattttttgctttctaaaacttacttttttacttttttcacttccccgcatctaaaacgccaaaccaaaaagtaaagagcaacctaaaaagtcaagatatacaaaatcctaaaggatttgagataatcatcaccagatctccaaagccagtcatcgaaatggtcagcaacaaaagccactacccaatctgttatagtattcgcttctcggaagatgtgctggactcgcaccacaacagtttggtgaaggatagtccagacatttcgagttagcgaatgaatctcgaactgcgtggcacctccctgaatcaagagataacaatagcagagtcatcctccagaaaaattctctccgcatgaagctgctacctggcaaaagtgacatccactaaagctatacgaagctcctccatcgaaactgaagcctcaaaaaggtgagatccatcaaccatcaaaagtctgtcatccggaccacggatgacaaagcttgcaccgcctctcccaactcggacactaccatcaaattttatcttaacaaacccctaaggtaggggttctcaagaaatggatagaaccctacggatcactgtcggacagctaaatagcttcagagtccaagtgtgtctagggacagagtggcagcatcaaagtggcagtatttctgagctaaaaagactgctctctcaagaacccaacgagcagaaatcacctcaccatcaaacacaagactattttgagacaaccaaatcggtaagcaatataaatcatccgtccaccatccatagccatccaatcaaccatactctgatggatcaagccaaggaaagaaatcaaccaagggtcagtacttgcctcccatggaaaactgtctgtctgtctccaaatgattttcatcctaagacatcacaggacagcgtgctccacagactcgtccttcatgccacagaccgaacacactggctgaacctccatatctctctccctgaaaagtgtctaagtaaggaggcagtcctagacaggttttcaaagaaaaatctaaaccctcggatgagtggcaactctctaaatccagacagactcaatccatctacagcgcatcggactgtacaataaagaaaggtccctcaatggaaccctcaagcagcagaaatatctgcagaccctcacatcctgtatgaggtaaacaggaatcgagatggcaaggatcctctccgccagtggctgcccgaagagctgagtgatctcctgtattctccagctagaattatcaatggtgataagatcagacaccctcatgtgatcctccacctcgatgctgacaagagtcggccaacgagataaaggaatgctcaaaactcaggcatcctaaatcacccccaccgaacgaccatcacccaccaagcatcggatttgatccatgacatcaggcccccgagtacaaatctcacaagcatcctcgggcaagctggatgatagttctatggctcgacctaccatagcaagctctcatcaccgtgctccataagcaattcggctggatcaaaaatctagccacatgtctggcaagcagagcctcccgcttcgtcaataaggaatagatccccaggccatcatcctgcatgggctgacatactacctcccaaaatagcagatggacctgacaacggtcacagtgagatccccataggaagttgcgaaactattgctccagttccctgatacaagcaatggggacaaccatgtgggacaataaataaatcagaataaagctcagcactgatctcaccgaggtggtcctgtccatgaaggagagggtggtggcctaccatctctgaagatgctcttgaatccactgctctaggggtctacactcagcctgtcgtaaacaacgccctatgatcggaaccccgagataggtcaatgacccagactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatgataaaaatattttcatcataaataatcaagtatttatgatgaaatttttttttatcatcataaaaagtgattatttatgatgaaaaattttattataaataaagactaattttttattttttaaaattttgatttttttaactattggcaataaaaatattttcatcataaataaaaatatttatgatgaaaattttttttcattacaaatactcaattatttatgatgtaataattttatcataaataatctttgcaatttttaaatttttaaattttttattttttcaaatattggtgatgaaaatatttttgttgggaataacattattttgataaaaaaatattttcgatcataaatacttaaattgttaacgatgaaaatatttttatcataaatatttaaaaatataaaattaaaatgaatgatgtattatttacgatgaaaatattcatcgtaaataattcgtatttacaacagaataattttttcatcgctaatatgcaactatttgtgatgaaaaattattttcatcataaatattttattatttatgatcaattttatttttcatcaccaataatattattgacgacgaaaatatttacatcgcaaataattctgtcgcaaaaatactctttttcttgtagtgtccagcttgatggccatgagactacgataatatggagctcgctgaaggtcatgcatgaacttctagaccagcaaaatattatcgatgatggaccatcctacttcgtgctgatcaagtgaggcatcagcggcttcagccatccaaccaaaattcttacacacactttgtagagggtcgtacaaaggcaaacaggtctgaaatgctcaggaagcacagcgtgcggctgtttcagaatgagagtgacaaggatccgcttctagaccttcagaacttttatagagtcaaaggccacctacaccgcctccactatctcctcctgaatgatcgaccagcactggcgaaagaagagaggaggaaaactagcaggtcccggggccttatcctctccaagagaccagggggcctcatgcacctcatcaaaagatacaggtctagtcaaaatcttgttctcctgtgtagtaatacagaccatcgactgagcatccaaaatgggacagtcctcatctagcgacctcatctatcgatccctgaagaagtgaaagatctcctttcggatccctccactatcagccacaataccaccgtcactcctccgtagctacctgatgcggttggtggaccttcaaatcatgatagactgatggaagaatctgatattccaatccccctcccgaatccactgaaccctagacctctgcctccagtagatctcctgttgtctcaggagagagtgatgctcaaagagcttacctcgtagcttccccaactcatgctcaagtaagccacctctccagtcttccctcagctgtagctcctcaatatcagcctcaacccgctcaatctgttggaagatgtcactcatctcccaatggttccacctgaggagtctacatctagccagctcaagcctgcgagtcatcctgtacctcgtatctccgtggatcaacatcctccacacatcccgaatcaagtctcaagatcccggataaaagatcaaaaacttctcaaactggaagggtgccctgagccagtccaggctatctgtcaaagcaagaatggggcagtgatccgagacaatcctagatagatactagacagagtactcaggatagcgctggatccaatcagtcgaagccagtgctcgatcaatcctctcccaaatcctagtagacccatgtcgattgttacaccaagtgaatctcgaaactgtaaaacaaaggtcgaccaatgtagtactgttaatgaattctctaaactccctggactctacagtgtccctctcctatctgccaccgcacttctcgtgggggccaataatgcaattaaagtcgctagccagagaaggcactccctgcaatgggagtctagtgatctccacccagagtaccctccgatctctgtacttggtactcacatagatacttgagaggaatcaggattgtccagactagtctgtgatgatgaggaccacctgctgcttacatttgtgaaaaatatcaatttgaatcaagcctcgatgccacatcatcaagatgccacctgacaaacctcgagactccacggcataagaactccaggccatggggatctgtcgtctggcccgggccagcccagtctcagagaggcgggtcttgcttagcacacaaatttcaggaacatgttgctggatcaaccgattgaaggtcgatcggaaggagggcttcctcgccctccgacaattccaaagcaatatcctcatagagaggacccactaggaagggggcctttcctcataccccctcctcaagagagttcaccacatccactacatttgaagattcctctatctcaacgattgctctctcaatagtgataacgtgtcagagtctagccatgatagcctcgtgagtgagaccctcaatctccatcctcttaggtgggacgccctccatcatggactcaacactatgctccgacacccccacctcctatgggccaccaggctcaccatcctatcccccgcacttcagtgggcccacctccacctccgatcaccctccacctcctccaaccagaccaagttgtccagagcaagccttgcttcctgtacaccacatcccggtcgacaaccaccctccgacacatggaagtggacaatggagacaaactccatcaaggctctcaaagacaaaaagttgccagaaagggccgatcggacccgtaaccagaaccctcggtcgcagtggacagccaaggtgcaagttggatgaatgcacgggtgaaccccagcggtcctcgatcgtaatggacggtcaaggtcaagttggatgcatgcacaggtaaatcccagccgctggatgtctaccgtgcaatcatcgagaaacaccaagtcaccagcaagcctctacacctttcggatggcctcctcatcccagtactccatcggaagccgggggaggcacacccacaccagggccatgaaaattatgcctttcgtcggaaagaaactaggtctccacagctcaagggcaagggcttgccctgccaccgtctatggccactggagcacctggtcttgctctgcttcctccccaaaccgtgcaaagaacaatcccttctccaagccgtacaccatgatttcacccttgagagctctccagagtcggaactccctggccaccaacttcggcggcaccctccatccaagacccttactaaccaatgtagttgccttccagcatgccaacctctcccgaagagccgcctctgggactcgcaccacctggtaagttctgtcacttcctccgatgatggctctggtgaaacccacacattctgcccctgtacaaccccttttcaattcctttccgacctgccttcatctttcaaacgatcacgcatcttcctcaccatgaaaccccagctcgacagcttcgatagcagtctggattgctggcgatcacagtcagaagaaaaatagcatgaatcttaaagcactcctaagtgcaaattccaaccaccgatgcagggatacgatcttgagttgactcaaaaaaaatacaaactagaagattgaaagcatgcatgtccgttgtatcatttgcaaactattcctatttcaaaaatgtgatttaggtccactgcaaagtgtaattagatttccatcttaaagttagcaacaataaatagcagatttttaaaatggccgatgacatactgtgttacaacagtgcactgaaacagtcgtcccacctttaccaaaaatgaaataattgtcccacttttgacaagaatctcaaaacgtcaggtgttgctggcaggtcttgaaatagaaattttattgtaatccagaggtatacatgcctaatggtggggcaaaaaaattcaggcctttgccaaatgaactaaattgctaaatattttggaagaaaaatccagagctaaaatattgctaagcacccgtacagtaataatttaatatatatgtatatatgaaagtaaaaattgaaagaaagtaggatagcaatttaagctatccacgtaagcacgaatttattacctataaataccatgtaaatcaaaaaaaatttataaaatattatttaattaaataaaaaaatattatgatgttaaagaattaaattaaaactcatatatgtaaattaaatgatgtgattaaaatccactcttacaatgaaagcccacttttgtaattaaatgatgtaactgataatatggattaatatcaagaatttgaatggacataattttatcatattaatttattaatttaaaaaataattatttttagaagattaataatgatatggtctaaaatcgacacactgcattgcatacgggctcaaaactagttataatatattctcttaaatgtgttgtctaaagcctatttaccttcatcgcttacacttcccttggcccctgtgaactaactccgccgagctttcagtcggaagttatattgatcaatgttacatacataagaaatttttgaagggtgacgttaacgttcgccaccatttctctctcttccctccatagtcctgctgtggtttcctccatagataaagttgatgatcatgtgtcttatgttaccttcgagacaataaccataaaacaaggctccttgcacctatgagtgagccctttcattcccttgcacgcatgggcaaaccgtggcagcaaaggcacagcttagaaattttgggcatgttacctaagcaagagattaaaaaaagcggcaacgatacaagagggtgactaataggctttgttctgtcttatacttctcactgatatctcaggttccacagtatcttttaaattttaaattaaaaaaaaaaatcaaactgaattttacgggctcaacaagttactaatatctctgagagatcaaatataattaaaaatttatatctaaatatacaataatagatgcaaatatcaatataatttaaattttcaaaatatgtcatgtgaaatagcaagctttaaaaatcttactcagtcttcattgactacggcctcgatcaattccgtaataagattcagaagagactaactcttaaatatagaacatccgatccatcaacgtgtaccaatgattagtcccactggctaggcccagaagaggactagctctgaaaatacggctacgattagcccaatgacaagaccaagagattaattttgaaaaacaaacatgcgaacgcatcaatatatgccagcaatcagtctcgactaactaagtccagaaggattaactctgccaacaatcagctccgactaactaggttcagaagaaacgtattttgacgtacagccaacgatcagtttccttaattagatttaaattatagtctaactcgagagtttttctcattatttccacaataattgattttcatagcaagattatactattttttataacaatagtaatttaagcttctacatcttattttcaaaaagtaacaaaatactttttattcaaaaaaaaaactcatgcagaggtgaatatgtataatttttatttttaaaaattatataatattaattaatcttctttccaagtaccgcataatagatttaaaataaaaaaattaatttatttcagattataatttgcaagaatcatatcatccaccttatgcttgacccataatttgaacaatcattttcatgatagcatgcatagcataaataatttctcaaaattttttaaanatttatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatattttattttataaaattaatttgaaatacatgataaaaatctcagagaacacaagaaacttacaatcagtcgaatctaaaagtcataatttttggtatgtggcctgatcctcagatttgtgctctttctgatcaagattaagatccttgatcagatctgaaaaggagaaaaatgcttggtttagattgtaatttcagttggatcatgtgatgaatctaaccatcttagattgatttagattcaattcgattggggtccaattaatggagcaattttaagaaggtaggctttccctttgccccttttttttttctttcttttcttttctttattttttcttctctttttctttctttttctctcttttttttttctttctctttctttctccgcgctctctctcttctctttctttccctcttcccaagccatagagggtttccactaaggggaagggcagagaggagaagaaggagatagagtcaacgatggcggtggcacggtggcagcgacaatgggttgcaagccggtggaatggttcttagcaagggttgatgaaaaactgggagaaatgggataacaatggtttgaaaaagaataatcgatcttaggagggcagcaacactcggcaagagcatgatggttgtggggatgaggaaggaggagagaggcggaggaggttttgatggtggatcaaccgagaggagaatgggatttaaaagaagagggtaggaaagagaataaactcaattaatcaatggataactcgatcgtttgctggcgtaatcaatccaaacaccttcagtcgtccctctaacacacaattcaggccgttctcacggccttatcctcatccatgccatgagattgggtaggggaaaacttcctctattttggtcgaagtcctctcttttaatttttttttttttgaaaagtttcaatgaagtcggcaatctttgctggcttcatgctttaccaggtccaatgagaccgattctcacattcttccctttttatataaaatttcatcataaaaatttgagaattttagatctttcgaagtaaagatgctcaaccccaaaaatttacatataccaagttgtccagctttggtatttctatcaaaccaaaagcatgatcacattattgcaagtaattcgaccactcgggtcaaccataatattcatacagatatttacgcctaagcatagactcctcctgagaatacttcataatttgacatctctatgtcaattctggaatttcacccccttgatatgcaaataaagatcttgtatctccttgattgaaattagtatgattaaaaattttccatcatatttagaattaagatacagactaataagattagcactactaaagcgactaagatattgggattgagatacatgcagtcattttaaattgagttgggatcaattagatgtaaaaatcttatagcaagattgattattaaaatcaattatatttggaatagagcttgaaatgatttcggtataaatactatgatgcagttttgattctacaaaagataatgttccaccttgattaaaatcaaataatcagatgactatgaaggtgatcatgattaggtagtaatggctttaggcaacaatattgatccatcataattatgaaaatgatttcaaaattaaatcataaaaattaaatcataaaaattaaatcttagaaaataaagtattgatatatgattcttatgttgaagtcgagatcataagaagtgaatgaatcaagcaaaatttattcagatacttaatagaccaaattttaatcaataatcaactaaccttatatataaggtgatcaaaatatttcttagcacaatcaatatagtcgtatcatgactagcctaagaatctatagtacttacgttctctttatgaatattttttttattggaggatcatatcttctatcataatatatatcaaactatgatcaatatttttgatcaattttaaatgaccaaaccaccacacttttactatgcaactctgattaatattctctaaaattttttaatgatcatagatttaaattttatgagatccaatcagattgggatccgattagtagagcgattttaaaaaggtagacttttcgattctcacaagtagtataatgtcgaaactagtttctcagattatatgttgataacatcagcatataatccctattggtggaaccatcttagaccagaaacatgctaaatatatgaatgcaaaagtatttttacaaatcattcggtcaaaattttagcattccttttcaacacgtgttcaacataacccattttagaaatataaatacatatttaattcttatattattttttatgataaaacataatatctttgaccatctaaccaaatagatatagaaatcataaaagctattttatcaagcaacataaactgtaattttcttacaaatttcttagaaaatacattgtaaagagtttagtcattttccttatggatgtcaaaatccaaatactttaatctggttacacgattgcttcgagacctaacaaatccaaagccataaacatttgacttagtggtacaccaatatttcaaaataatttctcaaatttttaaaattctcaaagattttaatttttaaattattgccattatagtagagaaaatgtgtcactaatcatatcctatcatgggcaggagagtaaggagacatggtagaagcccctctagggctagcttaaatgtcaattcgaggtagcaaaaaattggtgctaaacacaagggtcctagccagtctacggtaaaacacatatttgacaccttagtttttagctaagagaaccacgaaccaaagagattaagggactaatagtggaacattcaactctatcatgcctcgcccccgaattggacttctacaatatacgaacatgatgagctgtccagtgaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcagaggaagcagctaatcaccataacgtcatcgactacggcgctaaaccagatggcgagacggattcgaccaaagcattccttgatgcatgggacgccgcctgcggctcgccagcacctgcgaccatcctggtgcccgccggcttcttcttggtgaatcacgtcactttccacggtccctgcaagagcagctacatcaccgtccagatcgacggtacccttgttgcaccaaccgattatgccaactttggaaagaccaagcaatggatgatgtttaatggagtccagggtgtctcggtgtccggcgggaccatcgatggccgtggcaagtctctctgggactgcaagaattccgacggggactgccccgaaggttcaaccgtacgtttcctcgggcggtccttcatttgatccatatttctttcttattgtaatttattctccgtcttaactcatatgataacgtaattcgtcatttaatttcttgatgcagtcgttaacgttcaggaagtcaaagaacgtaacgatcagtgggttgaggtcgaggaacagcgagctgtaccacatggtgatcgaagactgcgagggggtgacggtgcaaggcgccaagatcgaggctccggaggacagcccgaacaccgacggcatccacatccacaagtccaccggcgtgacgcttatccggtccgatatcgggaccggcgatgactgcgtctcggtcggccccgacacgacaggcctgtggatcgagcaggtcacctgcgggcccggccacggcataaggtgaggccagtgggacgagttagggtcgtatcttccgcgcggaagaatgatatccaccttcctttccgtgcatccgatctttggagtgctttgcggagcatcattctttcccgcgaaagatacacgtacgtacgtacgtttgcatggtgtgggtacgccattgcatgtcgtgtgtgcgtgggtaggatcatcaaaattaactgtgtttgacacgtgtgggagtcttttagatgttgttgagtgcatgcatgtgattgctggtacgtggcttgcagcattgggagcctggggaaggtgtatgaggagaagggggtggagaacgtgacggtgaagttggtggagttgaccgggacgacgaacgggctgcggataaagtcgtgggggaggccgagcacggggttcgtcaacaatgtgctgttccaaaacgtcacgatgcaaaatgtcaaacatcccatcatcattgatcagaattactgtccccaccacgagggatgccctggcaaggtaatgcaattaagtctaattccaggggcaccgctaacatatctcgttacattttgaaccataccttgaatgattgccacatcatctccttataaagatggacatttctcaaacaagatacgtggatatggcatgtgttacacctcttttgtttgatagttgtctgtcaggggatccgaatacatggcatgttgtgattgggagatggaccctctctacgacctcaagaggggattattttgtttttggtatcaatatgtatatatatataagttacggcttttctgagctggaatttttaaaactcaagatgtctcttttctaaatttgcactggttcaattcttaccataatctctgcttcacctttactttttctcaggattctgggataaagatcagccaggtgagttacagtaacatccggggatcatctgcgacagaagaggcagtaacgtttaattgcagtgcggctaacccatgcaacggaataaggctagaagagatagaactgacatatcgaaatgagccagctaagtcatcttgtgaccatgctcaaggcacttcctttggcagggtcaatcctccaagttgtcttcagtaattttgagcataaaatatatcgaaataaaattttcagttttgttgttcttattatgccaacttaatctaataacgcatgaagttccaatatttgaagctcaccacatattgatatcatatcaggcgttgccaaaatgactgtttcaagatacagcattcctctgatttatcaaatgctttatgataaaattagattgatcatgtaatctttatgactacaaactctgttggctcgaatggttatacaaggcagttctgaaagcagactttgtgccccttatttcagtcttaaattactagttctggtagtaatgctctcgagtttcaccatggactttgatggtatacgagtatttagtcagaattgagctgaattctacctgggtcatgagtcagcacccaactataaaattatgagctatctaagagcatttgttaatcctaaaccgggctcaatctagctaccatgcacggtttagtaacaatgcaagttgggtcgggctcaagctacatgaagacccatccaacctgctcattgagtgggattggatttatattttataaatttggcttatgatcatacatattctaaatgtctgagtgtttcgaattcatttatatgacatatatagatcacttgcatgtttcatataattatatcttcaatcttgttgaattatgtcaaagtgtgtcattgaaatggataaatgattgagacctcaattcaatgaccattaaaactatcccaaacatttgtcccattgatcttaaattcatttttctgcccaatctaacttgatttatgtggcctgacctgaccgacccaaccaacctgctgataacctaaaactgggttgggttgggttggattggatttggttggtacaggattggattcggtatgggttaagagatataaaggttgagttggcatggggtttgcccgcgatccaatctaacccacccaagttgcagccctaccttttagctcctaattaaatctaacatggttagaaccatcccattttgttaggcaattgatgcatatgttcagatttaaggttggtcttgatgattatcactaaactaaaaaatagattggttatatcaatacctaaatacatgactaaaaaaacatataataccacatttttcttaagaaatatacactaacataattaataatattatcataaaagaagtggttacattggcatgtaacatgtgactattgatcaaaaaattgcattaatcattaattctatttatcggctactgaatgatttctttcaaacaaatccttttggagattcttataacagtttcccttaacaatattaactatcagtccaaaattcatagaactgaggaaatgcaggaaccttgatacttgaatttgttttattacaaagtttttgttaaaagtgcttaggtaggccttgggtacttaggcatggccaaggtgaggtcttgagccgttattctttggctgctaggaggagtgacttaaaagcaatccctaaatcataaaatatattgaaatttagaacaatgagaggtatttaagcattataaaattttacaattctgttgctccgtttttcatctagtttaaatttatatctctccaaaatcacagtcatattttatgtggcctattcatatccaaattaaattgaaccaatttgccttatgaaaccttaatattagataggaaaaatatcactcttggcccactttagtggagtcaaattcctggtcaagcctatgctagagtaagttattaatttccttaatttggttttacttgatttatcttgtaaactatcctataaattacaaatgattgcataaagcaaattcataaatatttataaagataaatgataaaataaaattagaaggcatatttagaatgaggcaaatgaagacatcatcctaagaatgaattttgcttctctcatacaggtttatggcgagattatcacaaagtaataatgaaaatagcttggtttgaatcctatctataagcttgatcacatgaaggtctaatgcaaataactcttttgattttcctggataagagacaaaagagcaaggaaaaaattgggagaaggaaattataagaaagaggctaacttactgtaggggaaaaaaggcatgttaactcacacaaggcaatgttagatgtgtgctctagatgccagattggctgacacattcctgtacaaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgtatgagttcttaccaataaaaccaatatatgagaaacaagcaaattgacaaccatgcaagcaatgaaatagccaattttttccttcgaattgttttgggaggaccagattcaaaaattaaaaaaaaaaagaggaattgttgtgggagaatattatgggacagaaattcctgcattttatggtgcttgaatgcaatgaatcagaatggtttacattgatttatgctctggaatttaaacacataggatgagcccctgattgactcttgaactctagaaaccttgagttgatataatcttttttattttgttcgaaaaaagtttcttttggtattaatacaagagacttggatccgatcttatcttggccttagttttcagctaggctttccctattctagtcaataaaagaaaaagaaaataaagatttggtgtacatcataaacgttatcttcaacctctactcagacataattcaagcaagtaaatattaattaaaacctaggtctagcccgaagattttggaccctcctgaacctaggtcaatgtaacttgctagtgacttggtcagattgaagctaatctttgacttgaaaccacaccgggtaggattgaatccaagccagtttcagacattaccctatcaactgacaactctatcaccctacgtgtggacatggagacaaaatccattttgcactaaagtgttggtttggtcaaattctgattttcttaacttgaagtagtaaaatatcatgttagccatcgagtttggctgggtccaattgcaacatccttttgaccaactcaccaggagaacatggggcaggtgcagttccaagtggcttggacctaaacctcaggctttaatatacatcaattccacggcaacaatataagaagtatggcctactactatctagaattccaatccaaatcaggtctaaattgggttcgttttgggtcaaatttgggtccacttcatcaaacccaaacctaaaaaatatgaacgcaacatgttcttgagagtcccaaaaaaatcatagttgtggacattttatgaacgcaaagttttctataccatcctttccggtgcttcatagctgtggacattttatggtagaagcttttcaccagcatgcaatcatttctccatgggaacgacttttcggccaggaatttttggtgcatactcccttcttttaccaccaaaacttgcgccaaaattgacgttgggtgatcgtggaccgagacaaacacaacccagcccttgtagactcctttttttttaagttatcgtggaaagttggataaattggtcaaccaaccgaacagagtcatctgtcggttggaattctcctgtttctcccccaagaatatacaatcccataaccatctgctaccagaatacaagctaagttggaatgtagatagtgtataacattaatgaataaatatcctttgtaaagctctaatagccatccaatagcctgggtccctctactatatctttggacagaggaatatctctgtgtaccaaagatccataccttcccaaactcttaaaaatcggccataacaatctcttatcttatgaatccagatcctccagcatcatccaaattaattttttaacattttaagggatgggaatagccacgcacagactcaacacctagtgggttagaataagtaattctgcagctactccatcatctcggttgacaattagaagaaatagacaaccggttctcaagcatttcagcataaaagaaccaaatttcttctgaaaaaagagacaaattctttcattccaaatttgccgagttatacgggcaaccagggctcaatcaagctagactttatgttacactccttccacaacaacttccaaggaacactcccaactgtccgaatccaacaacccacattgcaatcaaagtcctcaaaagagacagtttcgatggtttaaacttggcacctttaacgtggccgccaataacgctgtgactccaccaaaatatacaaatttcggtgcgtctttaccagaaaacagccctacacgtaactcagaaaggtttcaaaccaagtcatcgtttgggaggggaggttgttaatttcccaccaatccaatcctttaaataccccttaaaactcctattacaagcaaccacatttctctgtacattctttagaagtatagtactagtccaatggcaaagctcattatcttcttcctattgaaactatttctcctctgctccctgccaagatcaaatgcagtctacaacgtactcaattttggagccaaagctgatggtaagacggactcggcccaaccactcctcaaagcttgggcggcggcgtgccgatcatcttccccggcgacaatccatgtgcctgcagggagttttctactaagccaagccatcttcaatggtccatgcaagaacacggcgatcaagttttcgatcgatgggacgatcatctcaccttcatattatggcaagtcaggtgcttctaaggaatggattgcgtttaacaatgtcgaaggcgtgacgattcgcggcggtaacctcgatggaagaggtggagctctgtggacctgcaaatttgatggccggagctgcccaaccggtgcaactgtaagtaaataagcataacatacctttgagaataatcatgtcatagttgcacgtattaattcagcatagatcactaaaactactttgcttaaatcaagcaacaatactagcatgtgcatgtcaccatgttgctagatggctagttagtagtgtttgatcaatagtatcatggccatttaagtgaattaaggcatttgctctgaaattgatttgtgttttccgatgaatttgcagtcactgaccttcagcaactcgaagaacatcatgatcgatggcgtaacatcgatcaacagcgagctgttccacattgccatcgtcggctgccaaggagtgaggattcaaggtgtttacatcctggcttcagggaacagccctaatactgatggcattcatgttcagatgtccaccggcgtcagcatagttcgggccaacatcaagaccggcgatgactgcatctccatcggaccgggcacctcgcacctttggattgagcgtgtgttctgtggaccagggcatggcatcaggtgaacatcttaagggaaaaaaattaatcaaggctaggtacatcttagtttggcccaaaaccaagcactattttgaccaaactaaggagcaaatgagtcagtatggctctaaaatttgcacataaagcaacatggatgaggcatgtgtcagctgaaatgcatcatttcttaattcttctagccctctatttgatgttcatatagatattttatttatgtacatgaggggctctagacttagacatgcatggaaacaaagttggtctacatgtggcctgcattctagacttatgcatacatgtagacaaattgacctaaatgcgaaataagtcattgccttatgtttttcatgaaccaaatgaagcacagaacactttcatttctaaaggattcttgaatttaagccaactcctcatgaaaggaacaagcattgaccaagtattctttatgtggaacacatcacacatatttttgaactttttcaaatcaacattgatgctgtgcccccattaggatttgaactatacacctctctgagtctgagaatgaacatttaggagaggtatgccaatagttgaacccaggtcatgttgaatagtcttgactagttgtgcactatacactgtattcaggtgttttccatgatataaatttagctaaatgtttttttttttttttttattaatttctatcttcaataaattgggtttaattcatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataaatttagctaaattgttttttttttttttattaatttcatcttcaataaattgggtttaatcatcccggattttggatgtgtttgttttgtatcagcattgggagcttaggcaagtcgggggatggactccaggtgaagggtgtacaaaatgtgactgctaaatctgtcatgtttgcgaacactcaaaacgggttcaggattaagacttggggaacaaatgctcgtggttacgttaaaggagttgcttttgtgaacgcactgatgagaaatgtccaaaaccctatcatcatcgatcagaactattgccctggaaaccaaaattgcccgggacaggtatatattgcttcaaattttaactgcagtaaatgcataaatagctttgatagcaattggcaatgaagtttttccttttttctttatatatctaattactaaccagttgcaaataatctttttctttttctttctttttttttgcagaattcgggcattgagatcagccatgtcaactacaaaaatattcgagggacatccgcaacagaagtcgctgtgaatttcgactgtagtccaagcaatccatgcaataaaattagattgaaagatattaagctcacctatcaaaatcggcgggcatggtcttcttgcaaacatgcttatggaattgccactggttctgttatcccaacaagttgtctttgatgcatatgccactggcattatgctattagtgtagggtagggtattgggtagtatgtgcattggcctgctcaagccgacactcgaatgcccttgtttcatgtatttttgcttgtgcacttatcttactccatggagaaaactaatttgttctttttttgaggttttcatattcacatctatgtttcttgttcccttatttcatttttctttttttttttcaagcatggtaccatgaatttccaaacggcaacaaaaatccccagcttgagggtagccttgttgaattgttgttcatttctaattcattgatactcgataagacctcgattctattagcagacatgtatagaaatacatggaaactgcaggggtaatacagctttcactgattaaatcaatgaagaaaaaatggaatttaacaatcacatggacaatggttcttaaattgaagttggaacttggttgcagcccaaagttcactcaagaaactattgtggaacttgatctctgtcatgtttagtctagttatacgatcagttcatttgaacatttttgtaacatggactaacactaaaatcaccttgaacctttcttttctttgtcttttgattattctaaatgactctcaacagtcaactaactacatccttggcaggccattactcgtttcttacctgaacttgcttggtagttgaatcctctgtttctaggtcttctattgttgctgtagagctctaattcaatcactctccttatgtgtttcttgggggtgatttcagctagatcttcccagttcatgcacaaaagcatattatttgtaagtgatatttctcatgctcataatatatggtcggataacatctttgttttttgacttttgtttttggacgagaaacattttctttgctttgaattgcgaatagattgttccctataaaatcaatattaggacagtggaagagatcaaacattctactccatttttcaaaaagcttactcttccatttcttgataattataatatttgcccctaacctttatttgttaatagagggtcagtattaggcatcaaaacgatagaaccatcatagcaaaatccttatttttgtggtggtgatgacctctcaggatgcgtttcaagagaacataccaaagaacatcttaccaatttgatgatacgttgaaaaaagattctattatttctctctccctatcagccatttactgccacaacgagagagtaccaagcttttatgtgatcgttaggttgtggttttttgcctttattttctctgtacattttgaggatgagatttcttgaaaatctagaatggtgagctataagaattgaaaaaccaaatttatagagagagaataaaattggaagcatctaatttgagatctatcttttataattttagttttaaatatctatttttactaatcatatctacttttaaaaaagttatgatctcttccaaccagaaaaaaaaaaaatctgatataaactttatattaatagacataattaatataaatatagatatagaaatcgatgaagaaatctagaaccttaattttgctgtttttcttattcttttcattcttttaagaggtttgtgttgagtgagatgaaaaaaatctgcctcttttttttttatcaaatcatattatggtattctatgaattctttacccatgcatatatcttgaaaaatgactttgctctaggatttttatcttggtcaaacatgttagtatgtagtgctatcaagcgtcacttgatacaatatttgcataaatcttggcttcttatcttagttgatgtaaagcaatcaattaaacccaagatatttgctaatagaatgtattcacaccactcaatattctccagccacctttttctttcttaaatatctttttaatcaacaaatatccaaaaacaattgccagatacaattcttaattcttgatttatcatatcaacgaagatttcaacatcttagtacggaaatattggccaaaatctcaagaaaatgttaattttattattttatttatttgttatattgagatgctttcatctccgcctggacggctcgccggtggagagttggaagcccagctccgctgcacctggcccgaccgtttcaccaccacccaaatctctctctgtctctctttctctcaggggaatggaaatggcggaaggggaggaagtgaggaacaagcaggtggtcttgaagggattcatcgtgggagctccgaaggagacggacatggagttgagggaggggacggccatgctgcgggctcccaaggggtcgggtgccatcctcgtgaagaacctctacctctcctgcgacccctacatgagagggaggatgagggagaactacgattcctacatccctcccttccaacccggctccgtacacccttctttctccttcttccccttcttcttcttcttcttcttcttcttaacttttcttagattttgctacttgtattcctgaaaaggtgatagagggctttggtgtatccaaagttgtggattccgacaatccaagtttcggtgtgggcgacttggtctcagggctaactggttgggaagagtatagtttaatttcgaagactgagcggctgaggaagattcagatcaacgatatccctctctcctatcatctcggtcttcttggtaggtcctttctcttattattgttgtggaaatcctgtcgagtttaagtttttgttactagatgtaccagcaaatttaaagacaattgtgcaacaatattgcaagctggaactattagcatcatgttttatcttttcggatttattcttgcaaagaaaagttgcatattattgcatattcaatatagtacgttatgaaagattgtagacaagtagtttccacataaatctacacgccacctcgtggtaaatgatgctttgctgcattgtcatgccattattgcttagcttcaatgttatttaaatggaggatcagtgtgcaagtaaaagaagctaattactgaggtgttgcaatcttttttatggaaaatgtgtgcctttgaacaaatatatgtgattttattgtttataatatagaggaaaaattatcaagtttcttgtaagttaagggatgctttctggcaatcccacagattttgtctgcctattctatttttgcatttgctcatttagcttttatatatgaatgggtcaatattgggaaacacggtcttttatcttcgatactcaaaaattatgaaccagcttattaacagggtatatgttctgtgttttatatctttcgatcgttttgtcggatctattgcatatgctattgaacaatgtagcctgaatcagttttttggcacaggtatgccaggttttacagcgtatgctggattctatgagatctgttctccaaagaacggagagtatgtctttgtgtctgctgcatcaggagcagtaggccagctagttggtcagcttgcaaagctacatggctgttatgttgttggaagtgcaggcacaaggcaaaaggtaggctcttgctgaatcattgatttcatatatatacatacatacatatatgtgtgtgtgtgcgcgcgcgcgcatgcgtgcttgggattagttgttttaattgagataactgaaatggcaaatcaggttgatcttctgaaggacaaactaggatttgatgaagctttcaattacaaagaggaatctgacttaaacatggctctgaaaaggtcagttcacaaagacagcatggaatgaactactgaggatcttaatttttctagtcgtggcttagtttattgcatctagtctatattagaaatgtgagcaaggttcctgcatcatatataaactatttatccattaataaaaaatttttgatatatgctttctacttgattatataagttatgacctaagtctataagtgacatcttagctggttgtttcaatttacttcatctttaaatttattattgtgcatttctgcctatcaaccctctcttcttgtagggttcttagaaagctattttagtgttagtatggtccaacttcaatacatggcatttttttttccttttctttgttcccttctctttttttctttttttttctttttttttttgaggctgttgagtttgaggaatcaccagttttatcaaaaactttttatgtaaaacctcatatttataagcatagatattgagaatggtatagtaggtgtaggagcagaggaggaaattgtgttattcattgagatgagatgtgatgtggatatcaaggatttggtttctaatagagtggggattcacatcataaaagacctgtttcaagagaatcactagctcctgggaacctcattaaacccatgttttagattttatgggacgcttaaattacctataacccaattggtaacttgcaagcacatgggttaactaaccctaccaaaaccaggtttcatcaaaatcttgttttagtggaacctagtaatcaaacaaaccattactgtatcatattattctcattaggcttgaagctcagaagtcactagtgttaaatagtcccatggtcactggcccactatacgtgtctatgttctattttgttgatatctggtacacagccttagcttatgaatatctctccctcctgtgatgctgtttctgattgcctcctataatgggtattgttgcattatttactctatcttcaggcacttctccagtgaaataatatatggcatcatcttgatggctgagattgcttcttcagacaagtttgtgtgtttgttttgttttttttttaaacagatgaaagaaggggaatggttttgccacaccaaatagccttttgtttagaggatctttcaggcttggccccatggccaagaactaattagcgagcccaaaggcaaagagcacatgtcataatggtccatagacccttgtatcatggtagttggcaaaatatgacccaaacctgctaagctatacaaaaatccacctgaaataaatgggtttggcgttcgggctggtcatttttaaattcagataaaaaatggtcaacatggaaccaacctatttatttactcccgaacctggtgggttgcccgagtcgaatcggctggaaattattggttcccaaacccatggaccatgttgatctcgctgttctatttgttgcattttgctcaattcttggttagttagtttttgatgtgatatattctaagtttttaaattttttgtgcttatgatgataagttgcaagtttaatatgatttttttgtttgtgatctttgccatgctatagcttaccttattttttagttatatatttaattggcaagtgcaaatttatattcgttgatggatgggcccttgtttatttaaaataaatgggtcgggcatgggttgaaaatctttttgacccaaatccactttgactcaacccaaccccaccaatttccagccccataccatggtcatggtactagaccttaacaccaagacaccataggactccattaaagaaaaagggagcagaagtcagactcttgaccactgaaagggtagagattgatttgtaagaggaatctgaaaaaatgcacatcctccttggtcatctctctccagttccatatgcaataagctcaatctagtttggcgaaaaatgcttcatttggtataaaatttcaaactcgcctaggtctgcacggctgcaccaagaatcgggaagcttcctgtgtaaatgaactctgcaaatgtttgtgcagggagcacgctatcctgttttgatcctatcaaaggttgatatactaacacaaggaagacagaggataactttcattatgaagtattttaagagaaaacatccttcaaatcgactgatatggtcttgattataattttgttgtcattttatcttgatagaaatgatcatattctgaaactcctgtaatgagcttatttaactatttatggatttcagtcgagctgtaaataataaatgacttgcccagacgatttttttttctaaaaaacaatccaaatataaagctttatatcaaattgtttagatcatatatctgaatacaaatagctgataatatgtgatttttgtacattggttgtggtgtatattgcaacatctcattttcgttaatttaatgatccttgaaggtctgcttgggtttgatatcaggtcacataaatttgctctatcactccatggagacttctctacttcaagtcatgcattctggtcaatcccctctggcaataaagagatttttttgttgatataatttcaatgaaacacataatttaatttagacaactgtgaacttttaagattaagtttttatttgctaatttccggtccaaacttgactgtctctgttcagacttttttttttttagagtgctgttcgaacatgtttgactcagttatgtacagtgtttgcaaaattgatggaatcttcaatttctttttctttttctttttattatagattggttgacaattttgtctatcaaataggttagatcataaagaaaataaaatctccatgctgaactgaaatttctcatcatcatgtgtcatattgctttctaaaggtttcagctttattatgtgatgcctggactcttgaatttctcatttgtcatgccttgtactggtcctcagcaccttcatcttttataacctgtgaaccttaggtattttcccgagggcatcgatatctactttgataacgtcggtggcccgatgcttgatgcagtgcttctcaacatgagactacatggtcgaattgctgtatgtggaatggtctctcagagtggagtctctgttcctcagggaatctgtaacctgttgtgtcttgtaacaaagagagtaaggatgcagggtttccttcagcacgaccatctgcacttgtttcctcagttcttggatcatatggttagttattacaagcaagggaaggttgtttacatagaagacatgagtgaaggacttgagagtgctccaaattcatttgttggcctattcactggtaaaaatgtaggcaagcaggtagtatgtgtttccgaagagtaattttcttttacatgcttggccttttatgttgttcttgtatgcactgtataacttcattctaataaatttcccaaattctcttgttcatttcttatcgtgtactgaaatgtttgtgaaacataaggagaagcatatgctgtttattagctggggtggcaatggttgaccgtttaatctgtttagattgattcaatccattatagatcaacttagtttatctgtttaataaaatggtcagatttaggtctagattttggatacatttaataaacattttgggttcaggttgatagatttttttttatctatattgtattcgatcccatctaattgccactcatatttattaggctttgaagcgtagtatatgagtaaaggacgggatgtatattcctcacaagtagtttattggaatacaatgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgaatgaaaacacagcagcaaacttaattagtacatatatatttgatattacaaaaataaccttctttattttcatttttgaaggattttttttttggcaaaagtgtcttttaagttgctaaaaccaaaaagaaaacaattctctttagactcttttggactactaaccccaagtctttaaaatgaatatcgttaagtttgactaatatatagatattggtgttggaggagagactcgaatggttttcttgtagatagtttaaatctaagtcggttgtgcaagtggagtgtgaatgcacggaaaaagtggagactaacttcttctaacctataaaaaggataatgataggatactattcttgtaggatcaaattcaaattgagtcatttttgttggttaaaaaaaaatatattttttatgaatttgataattgagttattttcttgtaaaattattataaaatatttcaatatgatgcaaaataatttttttttaataaattaaaaataaaatcaagactgcaaagaaaaatactttgtgtatcttaggggtgcctcaatatgcacctaaatttttgtgaaatatcaaaaataaaataaatagaaaccagatttgatacttgctagaatttatgtttgatatatgcttagcaacatctttttcaaatataagagtaaaataaatatttaaagcttcaatatttttatgataattaaaggtttagaagtcaggaagtagcagatattaggtatttgaaagaaaattttcaaaatttctccataaaaaaacagaacatatgatgtaaattttataaaataaaatatatcaaaatatttctatatttgtacatgtgtattgagataacgagaatttggagaggcaaaaagaagnnnnnnnnnnnnnnnnnnnnaacaacatcactaataattcatgaatgcttcaacgattcaaagttcaaacaataacatatgacgttttggaagaatcaaagaaaaataaagtttttattctggtagaaatatcatattttttgtgatttttacttgggggaaaaggggaacaaactgttgttattgggggtggtggctgaatcttccaaatggctccacccatcccccttttttttctctcctgaaattgtttaatttattaattggctgagtgtggaaactccgcaaagcatgacaagtcttccaccctctggtcgttgttgatttccgcgttcccgttccccgcaacttcttctctcgtcccactttctttttttttttaagggtttggattggatttcgtccgtcggactacttgccactcttctacgcgccacggcggtcgctggtgagtgacaagtttcgatttttttgtcattttttcaagaatttaagatgctctttttagtctgtgagttggtcgttagtggaatcttctggctattttgggtcaagctgggatctttcatctttcttcctgggggtatgcttggattttagttatgctgatgaatttggccaatctagtgatggagttttgtggattttagagatctcggtggagttcttcgatatgtttttccaccaattttttggaaaaggcccgacttttcgtttggagggtttgatgggtgaattatagggccaaaagaaattctatttagaatattgactattaagttttcttccattagaatcatagttcagttgtcttcttttttgtatacgtggtttgtcatggatgaaatgttctgatttttgttgctgttgtcgttgttgttgttgttgtttttagtaataactctggacagaatttgccgagtttgatggtggaagtgtaaggtcttctgagcttgattattcaataatatgcgttttttggctcgcaaatggtacttccttatggtggtttgtctgttggagatgatatctttttcttttttcctttcaataattgtgcatacaagttgctgtgatttgatggtggaagtgattggcgttttctgaggttaattctaacctattcgattgatatatttggatctgatgggtttaaagttggatctctagtcattaaggttttgtgggtttaaaaattgcaccttagtgctctagttttttgcttttatcttgctttatgagctctattttctcgtcttcttagttgaacttttagctttctgaatcagtgggtctggatcttgctggaatttggtttgagtttcactgggttggaaggattagatgagagagttctgtagtttgagggtccgggccaaataatctgtctggcgtaaggatcttttgtgctgattacaaaaggaagcagcagttttttttttaaccattggtttttccaagtatgctgtctcctccaatccttttgagttccggtgacaagataacttttctcagattggagcctgttggtcagggttcttgggtcgaatgacttggaaccgaatagtttctgtattctgcgtagtgtacttcttctgttgtgcagactctgcatgtacattgctcgccttttttggattcattcttttccattctgaatgtcagatatcagtgttttttatgatcggtggtgctagagttgaatatgctcattatcaagcatgtttatagttcatctgatgctcaggtaaaagttgaattaggtttcgctgctgcttcttattcttcaagcaaacaactgtgttatcggatatgttttacttgctcgttctacatgtgaagtgtaatccatgaggttgtatatgagtagctaaatacttcctgtctctttaactgttttctctatttttagctgttggactgagttctgtttcttggtagtgacatgttttacaatgtgatccctatttcatgtctttactatgttatggcatgaaaattgaggacatatggctaaagttcttcttttgtcgtctcacctgttgaacttccatatggttatctttactcttcagaacttcctggtctttgaagctcactaggagaaaccttctagataggggaatgaaccctctttagaactttctaggaacttgtacacacacctgcttcctaagcgcttccttcctacaaagtttttaactgtctgctttcctgaacccacatctacctactaatatcttaacattcaaggaggagtacactaaattacttagctgccttttgcttgttgaatttagaattctgtaggtattataatacattttcttatttagcatgataaaatccatttttttgacaaaacttggatcatatttttgtgcaggtacagcaggaacctggagagcaataatgcttgtccattatacagcttagttggttgtctagaatctgcattcagccgatgtgcctagttttttattgcttatgaccatggaaagtatagctatcattattcttcttcagacccttctctggttattgctgggtaatgtatgttatggtactcaaactgatattaaatgcctgagaacattacagcgatcattgaatgaccccaacaacatgctgacatattcgtggaaatttgataacttgactgagggcttcatgtgcaaatttaatggcgtagattgctggcatcctgatgaaagcagggtccttaatctgcgtctctccaacatgggtctgcaagggcaattcccctcaggtcttgagtattgtaccagtttgactggactggatctctcaaacaacaatttttctggaaccattccacctgacatctcgaaaaagctgccttatgtaacttctcttgatctctcctttaacagtttctctggtgaaattccagtgagcctgtcaaactgtacctaccttaatgtcctcaatcttcaacacaaccgactgactggccagatccctgggcaaattggtggtcttgatcgattgacgacattcaatgtggctgacaatttgttgtcaggaccaattccttcatttaagaagtccttccaagctatatactttgcaaacaatcaagggctttgtgggaaacccttggaatattgtaaggggcctccaaagaaaagccatactgcagtcgttgtgggagcagccattggtggcgcactatttaccatcatagtggtgggagttattatattctattgtttgcgtaatgtgcccatcaggaaaaaggaaaaggatgctgatgaaaacaagtgggtgaagagcataaagggagccaaaggcgtcaaggcaagttgactatatttcatgtcctcttaatttaaatctgtaaggacagcttaagtactatagtctttttgccttatttaaggttcatatagacttacaatgaattcttgtatccaggtttctatgttcgagaagtccatttcaaagatgaagttgaatgatctcatgaaagcaaccaatgattttagcaaagagaacatcattggtacagggagaacgggaactatgtacaaggcaatgctttctgatggctcttatcttgctgtcaaaaggctacaggattcccaacattctgaatcacagttcatctcagagatggcaacattaggaaatgtaaggcatcgcaacttggttcctcttctgggcttctgtgttgctaagaaggagaggttgttagtatacaaacacatgcccagggggaccctttatgatcaattacatcaggtggatgacaaggagaaagtactggaatggccactgaggctaaaaatcagtatcggggcagcaaaagggctagcatggcttcaccatagttgcaaccctcgcatccttcatcgtaacataagctccaaatgcatccttctggatgaagattatgaacctaagatatctgactttggacttgcaaggcttatgaatccaattgatacacatcttagcactttcatcaatggtgagtttggtgacttgggttatgtggcccctgaatatacacgcactctggtggcaactccaaagggtgatgtttacagctttggaacagttctacttgagctggttactggggaaagaccaactcaggtgtctaaagctccagaaagcttcaaaggcaacttggtggagtggattacttatctttcaaatggttctcttcttcaggatgccattgataagtccttaataggaaaggataatgacagggagctcctccaggttttgaaggttgcatgttcttgtgttctgtcagctcctaaggagaggccaactatgtttgaagtataccagcttctaagagctatcggggaaagatatcactttactactgatgatgaaataatgctgcaacctcaaagtcttgatgctgattacctggatgaacttattgtggcacagtgagacagttggctgaatccagaagaaaagcaaattatcactagttttatgaattcttgtgctacaacccccttttgcaattcatgagatgcagttttacctgcctctcacatacatagcacatgctcaagtcttgtaattgtttgctgaaaggagcaaagcaacttatatctatttatcatagacagaggtatctatatgtattgcctgctggctgtcttttgtatggcaggtatatatagatctctatgctgcatattttagatgaagttttagtttctaaaataatatataaactatcaattagacagtgattctagtacttgccttttcgtggtgaataataaccttgtgtatatgttgctcttataatttgaaaatattaattgctatattcttccatcctctttatcatatttgttgcatcattgcctactatgtaatttgacaccctaaagaataattgtacattgctgaggaaacattgaaatgaaccactacttctgtttgtccataaaactatatgcacgtggaagtgaaaatgcaatgcaaagagaatggcatgctaattgccttagtaatattagcttttgtgggaaccaaccctccccctcccccccgcctcctcaatttcctgggctgccatttgttttggtgcttttattggcttcaagatctctacgtgctcttgttcctttcataaagttgtacattttcctactggtgcatttcctgagttgtcatttctcttcctaatggtacatttcctgtgttgccatttctcttaatgctctttttcgttgactgaaaaggttcctttcctagtggtacatttctatggtgctgcttctccctgtgcttgcaattcattccttgttgtgtaagtgatcactgatagattttacttgtatgcatatttaaaggtttatgccattttcctgccaaagacatcatatcaccttcaggtctatcttccaatttcaccaagaagcataattaataaaagcatgtttgttctattaaaacgagctccacttgctactgaggtacaggttgattttgtattcaaattggaaatgtttggttttaaatctctagttttttcttctccatctgtgtaaaggaagttgacagttgaaattttacatgaaatgttttgcatggaatattgcagacctgaagtgaaattttacttcttaagaatcataaccatagcaaagatgggaagtcccacctcctgcgccattccttgttttatgttattctttcatgggtccacgtcggttcaatttagttcttctttggtatttgtctgaaacttttctccaattgctttccacctcctctattagaacatgtctcacaaggaattgtaagtggttcgataaccaactttaaaattactgacacataaatgaatgacccttaaagcaggaacaagatagtgctcttaaactttaagggtttgaagcactgttgtttatttgacttgttccaattacataactagttgcctgttatttccttccttttgagtgaatatgaaaagcttgttttagacttggctaaaataatcccaaatagtgattttaaactgtggaagcactgtttttcatttggcttgttacagcaactttactagttgctttttctgtcttctcttttggatgaatatttcatatctcattgaaatttggctaaattaacctcttatgtaacccactcacatgttactatttagaaatggctatttatcgccttgttgctgattttattcatccagatgattgcttatcactgtactcagatagattatgtttggtgtttggctgctggaagtttctctaatcttttaacatcagttttgatttctatgtagataaagaacaattgacactttgattgcagtactttccactttctttggtaacatttaactttgaaattgcctgacatgatctaatctgtcacagttagagcttgatatccagcagtaaaatgtggggaactttgcagatgctatttgaaatattaatatattataaaatgagatttactctgttgtgcatcttgggatctgcagtcagggtgtagacaaagcactcttatggcatagttagttttgttccaaatttttttttaaaaaaaaattatctgtttctctttttccccttcttttagtagtccatatgaaaactggtttccagtgtctcaaaggaaaatgctaaaacaagtttgggtggatttgttctcccttcgttccagaaatgaagtgctagaatgataccaactccagcaaatcactacaatgaccaactcaaacaaataactacaagagttatgcaccttagcaaccaaaggctgaaatctttgaaaatatttaaaaaaaaaagaactcaaaatctaaaagaagcagtaaagcattctttctttttttttttttttgttcatctggttgtataggtcttgtagtggctattacatgatccagcagtatatattacaaaaaaagataaatcatttttttataggaaatatacaacctgaatcctgcacgttgactacttaatcatgaagcagggcatcatcccatccgatggtaatgtgcaagtcatcatcctcaaattgtagtgggtcgttaagcttaaattatcttttttcttttttttttaacggggggtacatagcttaaattacctattggtaaattcgtttgcctctgatgggtgagagagagagagagagagagaggaacggtcatgaactaaaagtaggagatttatacaaacaataacgaaaaaaaggaacaaaaaattataaaaatatctcttcaattttagtctaattttatttatatctatgtactttaaaaagtgtcaaattagttcttctagttatcaatatattctaatatggttcagtcgtctatcttcattaacagaattttataaaatgatgaaaatattcttatttttatctcttccctccttcctctttcttcctctctgattgatcctctcctctatctctggaatcttctttctccctcatcctcttcttcctcgtcactcatttctccttctccacgatggcttcctccatcttcctcatcttctttctctccatcctcttctccttcttgttctcctccttcgatccatttcttatggccgacaattcctctccctttccctttttatccacttttttgctcatcctcttccttctcattatcctcttcttcctccaaactcacccatgacctcatcgttctataacgaccctcttgacatccaccctttttcaccggcaacccattcttcctcctcctcacccatatctcctcctccatgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcatgacagctttaaaagtcataatagcttcattttagaatgcaccacccacatagtgtctggataatgccagcagaatttcctttatggtgttcatgctacacaatctgccctttacagacctaaaattagctctagtttctgtaatcattttcactctgaagcttttacattttcagaacgcccattttgtgcaggaatgctttcaaagatgagttgactctactggaaaaggtgaggcatcctaatgtagttcagtttgtgggagctgttacccaaaatatacccatgatgattgtctcagagtaccatccgagagtatgtttcaatttttctccttccaaattgtaatatggaactcagcaatgtatttattccttaaggctcttggtcattatgactttgttttggactatccaaagtctaatattgttgtatcctgcatatagttctgaatgctgaactttttatgatgtgaatgagctgttgttctgtttcacaccttaagcttttcaacactcagaattaatgttattgacctatctgtttttcttaaatgttattagttaagatggtttttattaagattatgaaattatgacactgtaaattttgctgctgtctgaactcagggtgatctgagaagctatcttcaaaagaaaggacgtttgcagcctcataaagttgtcagatttgcccttgatattgccaggcatgtcattgtatacttttaaattactgtactgaaaactaagttgatgctaagctgccaggatctttttctgtgtatggttggtttccgtttaaaaaattttgcttcgattctattcatctatttgacaagaattaatgttgagaaaagttctttgcttttccacaacactgattccctcttacaccattaaacttcaagttttgctcaacatatgaagtataaattccatatgattgatacttcaccaaattgagttggctgtcctggttgggatgtgggtacatgacaatgttcaaaatcacttaacttgagctaccaatgatttccaatcatttctatgccactatatgcctgttgcattcacattttggtatttcattcacattggaagttcaaggtacaagctctggtgtatgggcacatcatatttagtgtagcaatcacctcaagcgagatgatgaggaaggatggctgacaccttgtcagagaaagaacctgtcttattgttgtgagaaagaggcaagggttaaatgaggcatcccctgtaacaaattagccattacttgatggtgttgaacaaaattatgataatcatctagggctagggtatccaaaatctcctaagaaattgtagtaaggcttgacagttatggctagcatcaatcgttagtactacaacctgtatatctaaatatatatacatgcctctactttcaaattttcaataatttgaggatccttctaaaatattgtttgttcttttgtattcaggggcatgaattatcttcatcagtgcaaaccagatccaataattcattgtgatttaaagccaaagtaagatgaccagatgaatagctcatcctaatataaaaattgaagcttatttatactcaatggattatggattgtactttactatttgaaattttggtaaggtgccagaaatatcttgctggatagtgggggccaattgaaggtggcaggctttggtttgatcaagctatcaaaaatttgccctgataaagcaaaattggctcatccaacagaaattgacatttcaagtaagtcccatcatttgtgatccaaaattaccaaattgtatattaaactataatttttcttttcaaaagtacaaattatttgttatgtaatattaaactaataatgatgactagaagagtagtctctgtaaattgccaacctatgtttctctaaggtactaattgtttcaaaaatcccatctaacatcatctctcaggcttttcctgttacaatgtgcagcaactaactttttctttttaactgtcccatgactcttaaacattgtatccaaaataacccccaaaagattgaaattgatatggaaatacattccatcctgtgattaatggattccaaaatcctagatcatctagaactgtctaccttagtatacatgtttatgaggttactattaggttagaattcttaactatactcaaggtttttcagattttcattttgttttcattagctcagtgaaactcaattagtgagggtcattctttttggaatggcaccccacctgtctttgcacatctcaatttttaatagtaacctccctatcatatcgtcttctcactaaataaatgtgcattttatcctgatggtattatagacatggtttgaattatctactaaagcttatagtgtaatttgattgtattatactacatactttgactctcaattcagtattgatcattctttcttcattctagatttatacatggcaccggaggtctacaaagatgaaatatttgacagaagtgtggatgtgtactcttttggtctcattgtttatgaggtttgtcagaatttttctggtttcagttaatattccagcatttccctccttgcagcagcatccatgcatatagctttcttcattaaagtgagtatataccttatgatatatgtatcagtaatgtgaaaacttaatattaaacagaaacaagtcaattaagttatgtacgagaatcagtacctgaattaaacttcctttcctgcataataaattgtgttgctggctgtgattgacatataatcagtcctttttggtctcttttgaaaagctaactggatttttttttcaagtcagaatgattgtgaagagtttctaaatttttccaccaaatcatttgcttttgtcacattagaccatactctgtgggcatcacaaaaagaagagaaataacttaaagatgaaatctgaagtcagattaaatagactgcatgcgttccctattgcttcttacctttttggctctttccccttactctctctttaagctgaaggtctggtcaagaattattcccctttagtaacttgaatatctatagcatttttctctacaaggcaaattgtgatcccttcataaacaacaggaaatgtagatatgaacatagtgttctaatgtctatcaccaacaagattttgttgtttctctctacctgaatctttgtcatctgaaccgaggcttcttcctagtgtatatttgtttccaccacttctttcttccttttacctccatttagattctctttcagtctctattgatccacatgaaaatatttccttggcctgagagagacggatgatgactctcatttcttgcatgtcatctaacttctacacatcaatgctctttcgaaatgttcttcttgctgcaaaaaatttggtttcttagtctgtttttcaggggcttgcacaatttctgatgctagtgtgtgaaaaagaactccacagtataattcatattctcaaccatcaaacagtaaaatcatggttttcaccttcatattctttcgagtagcatgtttctttgcatcgattacctttatattcttttgagttgcctcctcctttgcattgatcaagcaagcaactcacctatttgggtatgtataaagcttgttagtaactttgataagctagcatgaattgtttcatatccttgatgtaaagatggattgcaatacaattttagagttatctctcttgctttctaagctgctcattagatatagggttctcatgtttgctatcagaatcttttcctgcagggctgttattgggctaaatatgatcatctatgatgatgatgaaaaacaaaaagcatattcgtgtcacttggatgccatcagttataaacaaggacattgttgtttctacaagatactgcacttgtatgatttgaatgatgtttaataaatttatgtttgaaataggtgctagtttacatttttttattgtttagctgttgcttgaagttcataatcatgcttttgggccattttcttttacatattggatttgattactaggataatgccgaccttcttttccgactgatatagtcctattcatagtttatgaatgaagttaattcatgtaaaacagctcagcaagttattcgttgctttaatgtatagcactacagcttaagcaaatatcatagggagtgagaaatctcgtttcccatgttttctcggaatggtgcttaggatgaattgatgaattggggtactaaattaaatttaaacattaacctttatctagaattattcaagtgaataaagatttccttagaccttgttttggtaaattttcttatggccttgaaattatgttttctatgatatgtccgtcatagtaaagctccaaggaatgctctaacattagcacatattgcaaaagccagatgtattgcatgggtccattttgatctcctgacaatgctttctttgaagcttgtcatgttggagttggatgtgaataaattaagattttctacaagtaaatgagatagaatgtagtggttggatttgtgattagtatggatatcttcaggaaaggaattggcttgatcagtgccctttgtatagagaatagaaggaaaacttgttcttcttgttacatttacattcttcatgtttaagaaagacctattagtaattgtctcgcatcatgtttaagagagcataggaagtatttacagtatacttgttatccatcatatatattttgcagattatcttaaaattgtctcttatgaagcagaatataagctttttttaatctactcttatgtttgttttgcatgttcaattggtttcagatgattgaaggagcaccagccttccacccgaaggccccggaggaggcggctaaaatactttgtttagaaggaaagagaccatcattaaagaacaaagcaaaaaagttatccttcagattttaaggagtaagtttgtaaattttatgagtcttaacttaaagttgttaatttttcttcatgcacggaacaaaatttttttttttggcaaaaagaattaccatgtgggaaacaatttaacattagttattatgcaatatcatagaggtttatttcaattgctgtatattgcatttacttacattaatttatcatttattggatcttaaggttgtcatctcttgaactaagaatactcaatcttgcaatataattggacctcctatcttatcatttatgcatgcttgaccaatacattctccagctacacaaataggaatccattattagctgagtcttacacatgtgagctaagtcttaggctttcccagaaccacttaacaacttcatctggtaggcagtcttttctacttgaccatctcttatccagagtctctagacattatgcatgcaatggatgtggcaaggcaatttgtcttgttctgcactttctggaaactttcctgctttggaacatatgttggttcaggccttggtcaactctgagcataaacaaatagattcagacaaattacagcataataacatgcttacgtatgtactttccttatgattgaaacaatgtactaactggtggcatatgcatagcatatgtggcatttatagaccaataattattattagggttttcctatctttctctctgcattatcctagttatcttagaactaggctgttcctcagttcagctttagtggccggccttgtctagagttgtagacagcacagggcgctacctgctcggttgagcttcaccaccctacacatatccaatacaggataattagaaataattagaaagcaacttgacatataggcttccatctttcttatttcttttctttggcctgtgggtgttgctgaagctcgctacacagaaaagctccttattgatacacaagtggtagtccatttatgaactcataacatgcctttatgccttggaatgttcaacagatgcttctgacaatgttgtatcatgcttactttcacaggtgcaaatttggttttccattgttattgcatttacttggatttatttttttcttcttgctacaattgcatttgctatgtaaccaaggcgagcttcatcaagctgtgatttgatccatctaaacttgaaactaattttgagcttgaaatccaagatcaagcttgacttgtttatcatttgatagcaggagcctagttatgtgcaaaactgaacataatcctgttttgattggccttggcaactatgaagccaaaattggtctagcttgtataaatcttgaattatatgcctgatcatttattctgactacaaataggtaggcaggtggaatttgactttctcatcctaagaacccaaaaatcagccattgaatctatttcagtggttgattatatgttcttatatgcatgttatgttatatgcccagtcagcacttatcgatccatgccttattgagccaaccttttctctgtattggcttgaaattaatttcaaccatgagaaccaaccaggttcaagatcagcctcattaacttccaaccaagcttgattaatcttatatttcagttgatctcaacccattctcaagaagctctgattaattgaaagccctgagtacatgatagcatctgaacgagtgcactatgtctgcctgtcttcttttcccaagacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtagcaaaatataactgttggcatggaatgatgaattacaaattgggttttaaagtgccatggaattctttgcaattacaattgcaggatatctctgttagccacatgttcatgtttgttattagttataatacttttgatggttgaccacaatgatttgggatctgaaccaagtataaaggtagtttaggtatgacaatgttccagaatgtattggttagatgagtttatctcgcaacaaaaaaaatatgaactattatgtcccaaaaaaagtttttttaaaaaaagaagctcaacaatctttggtccatcaactcagtccatccttttttttttccattacaattcagactgttctattttgcaatttacaccacatctatgtgcataccctcaggaaaataaatgaatattttttttgaatatgttgcacatcacttttttatgttgtaacatattactttggacatctattcagagagtgtacttatatatccttctattttaatatatggttggaatacatatgcatcaattttttggtgtctatagtttgatatgtatcttaaagaaaagaaggaaaaagaaggctgacatattttccactttcatcatatacatattttcccttcattttcacaaactgatttgttgtttagacttatgatacaaatacatgtgccaccatcgacattcatttttttcttacagtatgttgaaaatgcctacatgaaatactccatgtgcaggttgattgaagaatgctgggattctaatactgcagtgaggcccacattttttgagataattgttcgattggacaaaacatatgccacttgtgccaaacagggatggtggaaagacacatttaagcttccttggtatgcacatatttaccctattatccacgagcaactttgtgagtgtcaagtcattagcattctttcatgtgtgaaatgaaaggcattcttaagatagaatatttatctgcagccaatgagatttattttgattcattttaagaatccgatcatgattagattttctgtgaacaagcatcgacatggttttgaagacactttcgagcaaactacttggcctataaatggaatttattggtgtaggatccattaagctgtcttcaaaacaatgaatgtcttttttaggtctacatttggtagttgagatgtgaaatcaactaatcatgtcaggccatcttgttgaattatatgttatggccagatgtgtaaccataccagtctgtttagtgcatctgaaagataaagataaaaagttcagtcagaaaagaacattgtctaaagtaattacaacgtccatgttttattgactggattctaaaattggcggcagtgatcgatcccccataactgtcagagaacgtaattgctccttaacttctgatcattttgccaaattataaccatctggtgctactacggataaactattttactttttaatgctggcaaagttttggtctttttcacacctacttttgtttgaccaattgatctaactcttatctaatttatgaatcatatgtatcacatcttgttgtcattttttatatagtgtagctgtctggttatttattttgttactacactgcatcagaaaattctctttgtagcttagtatcaataccttcaagatttattttgaaatggctaaagctccctattcttttcatattgctgcaaaagttacaagttctgtccataattgtagtatcacaaatgtttttgaaataatgttggtgaattatttattttgttaatgtacattattggtacttaatgcagtcataaagtagcattcttgctatcacattcccctagcaattccttttttcctttttcttttgctaattaagaagacatccttaagcaattctaactttgccattatctattaaaccataaactgtctatctgaatactgtgagaagtgcttgaattttccttttgttttctaataaataggtttgataaaaatctccatccatccactaactctttgtaaattcttatcaagtaaaaagtcctttcctgctaatatgcttcattcatgtgtaagtttcttcttttttatttaacttggaaaatttcatgtgtaaattgggtggatgagtacatattgattctctgttgcatcatacgtgcataatgaacttgtcagtgatcaagggtcaatggcaattttttttagaattgaaacaggttttttttcttttaatctagtacaaaactgcataatgaacttgtcatcaagggtcgatgttgatttgtttttgaatcaaaataggtcttttatctaatacaaaactctccagttctgctatctgtctttctctcttcttctacaaatcttgcattgcttccagatccgtttgattcaagcttatttttccttctccctctctttatagttttttcattttgtttgaacaatttgaattttaagttgttctttcaactaatctcttgtattgctctgggcgacttttctgatgcttttcaggaaatagcgtgaagtgatgggctcattctgtgctacaagatgttgttgtactatatgtaagaataagcttctttcaacaacatatgtttgaaaattatgatgtattcttgttgttaagagactcgaacatttccattatgaatttccaaagtttctaaataaaccatcagtttgtgtttcctagttccttattctatattgcaaaactgtagctaatgatcaaaactcatatgcaggacgctcactctttttggagtctcagatctgccagaccttgcattgtacttgcaccccttttgtaggatactagtgatgcaatatgggcaggtgaacgagatatgaattaggccacaaatagatcgtctacttcagacactggcagggacttaaatgaatgaatctttctgaatagatacaatgaatcaaacattgacagcaggtcagagtagaccgcaccagtattgggttctgagtgggattaagttgaagcaggaaaatgcttgtgaattttgacaccattattggaaaataaattggttttttccttttattttatacgaaagttctcaggcaaatctatttctttttctattcttcttttttttttgtttccttttagattattaaagccctacaagttagacactgttgcacaaagccctgacctgatctttggacattgagactcctatggttagtatgacaaagcctccaaaccatgcatgttgccctagagatgcctccaaatatcaggacaactgttagtgatatttgagagcacatccacaagatatgaacctaaaacatcctctaaatagtttccttctgttgttctctttctcggcttcccattatttgtgtatgtgcacacgtgggaaaaaaagaaaaaaaaggaagtactgcaccatgaattcatggaacaaggccaaactagagcttagcatggaactagattttctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatataatatattatattagtataatataatataattatattattattaaaatattattatgttatattgtattattataatgtaataatattataatagattatattatatgtctataacataaatagtattatgttttaaaatattattttattgtatcatattattatcatatcatataatataatatatactataatataatattattataattatgatgtaatacataatgtaatatattataatggattataatctaatctaataataaattataatataacagatcatattatattattgtaatataataatattatattattaataaatattattatatcaaattatattttaataatataataatactataataaattatattatatatttataatatatcgtaatattaatttattattatattatttatatttataatataataatataatatgatataattatgagatttgttagtgggtatttctgtcattaaaaaaaaattatttaaattaaaacagcttcctgatattagtcagaaagcatttttggaaaaagcttcaaaatacagctttcctcaagtaaaccttttcagctttttggcaaagccaaaatagctttttgattttttaccaaacatcactgtatcatcctaaagtgctttatgagagtcctaaaatattttctgagagtcagaaagtgctttttggcacactaaaagcttagcctaacagggccttagcacggcaaaagctaaagtgaaagctaagaagttggaggaatcctagaggattgtaaaatctatcataaagaagttctgggccaaacttcttggggttggtccttctttgggagctgttgcttctatgagcaggttttaactctatccttttgcctattgtcttctgcatttgagtccattctgaagttctacaatcataatttcttgatttttttaccttttttcttttttcaaggtcggactgggccgtaaagttccaccattggaaggatgaatttgtgtctgttctgcagcattactggctgggtttgaaactactttgggcagatataagaatttcctcgagcttacttttgaagcttgctggtggaaagaacctctcaagaagagaacagcagcagctaactagcaccacagccgatatcttctggctggttccttttgcagtttttattatagttccatttatggagttcttgctgtcagttttcctgaaattatttcccaacatgttgctatctacttttcaggacaagatgaaagaacaggtatgctttcaaaggtttccactgtggtcaggaaattcactttgttatctctattttttcttgagagagagaaagattggacagagtcaactttgttatctacatgttgaactttgatacgtagaggttcttgtttctgccaatccccaaaggtcaatttttcaaatttttgatttgtggaaactgaaactgtgcacagttaaagagatctgcagtatttattgtgataagttggattgtcatctcgctaggtgtgttcataaaagcttatgagcaaattcttgttaacctttttttttccatttatgaagtgtatggcaacctgtaatttgatatattctgttgttatccttcccaaggagaacattcaacctcactactgtctcgtgacaaataacctgtaggaagcttttaaaaaggcatctcaaagcaagaatggagtatgcaaagtttttacaggatacagtgaaagaaacggcaaaagaagtcaaagactcacgaaatggagaaattaaacagactgcagaggatcttgatgaattcttgaacaaggtaatatttttcttgactacattactcttttgcactattatcaatgtgctatttcacttcttctgtttgcttttttagcgtcatgagcatttgaactaaattcttgttaggctagaactggtgcatgggtttccaatgatgaaattttaagttttgcaaagttgtttaatgacgagctgactctggacaatatcagccggtcacggttatgatgctaactatgtgtaagtatacatttcatatgcttatcttgtgttattgcatcactgatttttttttttttttttaaatgtgtgcaggccaagattggttaatatgtgtaagtatatgggaatcccaccatatggaacagataattatttgcggtttatgcttcgaagaaaattattttggtaggttatatgtttttaaagttcaaagaaaatgcatcatcctaacttttattatcaaatttagtggctaatcagtgggagatgatggatattggttgtcttacacaatggcctggggacatctttttttgtattgttggtatatgctatatgggtttccataaacattgggtaccacctcacttaggagtgcacactgagcagggtcagcccatggcttgcccgaccagcatacatcataagaaggttgggccaatatttttatggtatgggttgaactcgagtcacaaagttttggcccaactaaaattaggctaggcttgggccaatgatttatgagcttgatagcccaacctagcctgaggcaatacttctatagcacatatatgtacagttggcatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatattacacaaatataataaaaaatataatattaaaactttaggtaaagatgctagtcatctaaggagtacaaccttgtttgggagagcttttggaaggccagaaagtgctttctggagagtgaaaagcactttcaggagatatggaagtgtttggtaaaatattaagaagtgctttcagatttctaaaaagctggaaagttctacttgggaaagttctattttggagattttctcaagagccctacttgactgatgtttggaagttgtttttgttttttaatgaaaatttcgtagcaacataatgacattatattataataatataataatacattactgtattatattatattatatcatgtcatgttacattatattattatactatgcaatattatattatattacattatcttgtaattatattatattatattatattatgttatgttatattttgttacatcatatcatattgttacattacaatactatataacattataatatatacattatatcacattataataatattatactatgtaatagtatgttactattattatactatagtatattatataatattatattatatatcttattatgtcatattatattgtactattatgctatactatacaataatatattacattatagtatttatcacattatattacattataacaatatcatactttgtaataatattttaatacgtaatattacattattatactagacaatactacaatattacaattacattataatatttatcatattatattatattataataattttatactttataataatattttaatatgtaataatatgtaatattatattattacacaagacaatactatgcaatgtcctttattgtcattttgtcataccaaaagtactttctcaacctttcactctgtgataaaggagatacttctagttaaaaaatccattgtgacattatacttgaatatggtgtggtaagattaggtaaggatagaaaaagttaattatacttaaattgattaagtacaggtatataaatctttagcttcatcaatggtgcaatctgaagttatgttgccaatgttgtttgcatagttaattgccattgcttttgataaaatatgtcgtattatccacttttctctaccacattgtcttcttatttgaaatttgttatggaagatatatttcatgatgtgaaataatgtgcaaaaattgggagattgatattgaatattattctttggaggtctggaagggagtttgaggaaaatattataatagatacttgtggagaaactgcaggccttaaggcccgttagtctcttataaacacaatattatagaaatcaatgttactaagctctccaagttattatatgttgtgatgtttgtttgtgtttcttaagcagacacaagattgctcatgattttgttatgacatgagtgcaaccttttttacacaagtttgtcaagctccgaattgtttattgtaggctttttttagaataaatattacttgtgattcattgtaacatatgaatgtgacctcttttttgcaaaagtttgttaagtttggaattgtttattgcaattttctcaataaatatatttagatgattgtgcctagtgatgatgatctccatgttatattgtgtatgttgatttaatgcttacatggtaataactaaacatattgcttacgtgattcatttattgaagatatacacctacttctaaggatgtcatgttttggtatttttgccacatttagtcaatgttcacaatctcagtaccagacctgtactggtaccatgctgacacaatgttagtatgtccgatacgtggattgattcagtgcaccaagtctttgttcggtatcggtttagtatggtatacctggtatggtgcggtatgtaccagaatggtgaatcttgctagttaatatgacggtgctaggtggtaaaattaggacgatgggtttactatgaggaaatcaggtggtgcaaagtgttatgatcttgtgacagacttgaattttgatagaactaaatggcataagaaatttaaaatatccaaatgaaaacagctgggatttggagtatcagtgatgttaggtttagaaaagagaataggattcctcacccccccccccttctctctcttcctcccctttggaggatgtccctgttcgctgattggcttctgctagaactatttggatattttctttgaagagccatttcattgtaatagggcttgggtttgtttctagttaagaagagagaggtaataagagtggctgcttttgaagattgtaactacatgatttacaatctcggaaccaccctatccccacctccaaaccaccacgatgaccaccatgcaagcacccacacatgcacaagagagagagagtgtgtgtgagaggagatgatgaaagacatttactttcaatttaggatttttcgaagctggaaagaaaaaagctattttatgcatgtgccttaaggcagggagcggggggacctttgacgataacacatacttgcccttaacctatttcctcttgagaagcaactaaccagaattggcagattctgcagcttgaaggacctcggaagataacacatacttcagaagattgaaatgagttaaaccgaaggcttgcctgagaagcaaccgagctctttgaaaattcagaatttctgtgatgatttaggtataagattatctagggaagcctgcacatttactgccatagtatggtgttaaagtggcatagtttgcagaccaccccccttttgcatggaagaatttgtccgggctttatatatatatatataaaatctgaatttgataatgatccacattttgccttttgttccttttcactgcttcttttaattaatttcaactctctttgtctagaattcagtcttttgatttttaaagtttgttggcattaccatggtttagcatcaaagaagcaatgattttttcccattgtttggacaggacaaaaaatgatgatatattgattcaggcagagggtgtagaatctcttttagaatgtgaacttaggcaagcatgtagggaccgaggacacctcggcttgctttcaaccgatgagatgtgccaataggtttacaatcatctttataatgttattggattttgtaaatgatagacccaattaaaaacaagtctcttaaagttttcttatgcctgtactaaggaaattctttgcttatttttctattgcatgcaccattggaaataaagtgcagatgtggaaaatacttagttattaatcattgttctgttttatctgtttacatatcaatttgctcttctacattcttatcgcttatgtatcagattctgatcagctaaccatttccttactgcaattattttctttatacttaatagcatttctagagtctactgtacggatcttaaagttttccaaatttcagcattttactaaaactttgctgagtctgatttgacgtcctcacctaggaaattacatttcacagttctgttattttagtcaaatttgctaatgaaaaactgctaatagttttactctttcaatgtttttatccagcttcgagactggttggatttgtctctcaaccgctcagtgccatcttctctcctgatactttctaggtagtttttcatctagttttttttttttttaaatatatgttgtttcctcctgattaatttggatgtcatttcttagagctttcactgtttctggaaatatgaaacccgaggaggcggttgcagctacactatcttctctacctgatgaggttgtggatactgttggtactggtttgccatctgaagatgctgtttcagagaggaggaggaaattggattaccttgaaatgcaagaagaacttatcaaggtacaatatcatatttattttcttgatgcatcttcctttatcattaccttatttgtttagtatcagtattgggagattaatgtattcaaacaatttattcaatggattagttttcacacttggctgtttggtttatgatttctgccttagagataaacaatgccgtgcccttcttctttttttttttgggggtggtcctcttctggacccttgtcaagtttatcttagaatgctgttcctagttgcataagcttgaaatgtaaaaccaagggattaattgtgaggccctctcctgctcatgtttccttgttaaaatttaagaatttgttagggattgacatcaggttaaccaatggtcttgatgatttgctaaatccttttccagcactactaatgtgcttaatccttgagccaagccttcttgtaatatgctccatttttttggctctagccttggttcatatctattggtctagttaattatgttaaattgtttgctactggttctactggacttctgggctaattggaatttgtcctttatcattagcaagccaatgttgtatgagtgcaattgttaaagcatgtttctatgcatagaatgataaagtttcctgcagaattaattgtgagtagatctgtataatcttgcactctactattttttgcaactgctaaatgatttccattatgtagaagcagacaacataaatcaagacattggaagactagatgatcatacatgttagcaaagaattgaatgattctaatgcaaaacattattagtctcaaagacttaaagtctaaacttcagtggtatatgaaatcatgaggagcaccacccaccagcctgccctgtaaaagggttcctttcttcatgtcctaaagtcttgaagcattgccatgtatctatcagccatctatatatgtgtacagctgtagttgtcatattctatttagctcttattatctttgtagtgtcacgagatgttctcatgctcaatgactagtcctgcacatatgttttttttaaatgcatagttctgcttctgagttcaattttccatcttttttattattggtatgttcaaccattagcatgtggtttcctacatttgattgttttctggcaaaactgtttcataaccgtggcattttcctgtatgagtgagtgtatccagctccagattattaggtcagattgctattaatagttttggtttgtatgcatagttctatttcatttccttctgaggtcgcccaacaaaaaaaaagaggaaatggaatatcaaagccatcatgttatgaattcaaattcactgtggcgcaaatgatagatgatgtgatttcattggcatcatggcatgtatatatctttcatgtatcaaactcgaaaactgtttgcatgtgatttgatattgttcaattatttgcatttaattgctcgtcagctattcaaaagcaaggattatcatcatgccttctacagcagaattctttcgatccttttttgcagtagctgctaatttgtcagacattatttttttccttcttaatgagcacataagtaaaatatgttggctgctatcatgatcctcttttaaaaattttattttactcaactttgcaatcctttgcatctcattgtgcattctgcaaatctttgtttttttggtgcttatgtaggagaaagaaagggatcaaaagaaagaggagaaagctaggatggaatctttgaggaatgatgaggatgtggctttgaaggagttaacaattcctaccgcaaaggaagtagaggagctggcaagaatgaaagcgtgggaaaaaagagaagacctctgtaaaatcagccgtgcattagctgttctagcttcagcatcagtaaggactgatatgaatatcctttcatcaacttttagctgtccctagcatttacaatgattttacaactgcttccaaaactcatatattgcttttccgttaaccttgcagtctgtcagcagggagcgtcaagagttcttgagtcttgttaacaaagaggtatatttcatcttttaggtatgaatattgctactttttgcatctaggcttgaatggctcactttatattgtcaaggtagaccatatgcacttatgaccggaagccttctcttatctctgggaataaaacttgtattctacatttcatactgcagatagaactgtacaacaccatgctcgagggtcttgaatgagaagcagctaagaaagcatatagtgcagtcagggagaatactgaccatgatgctgaagcagctgcagaagataaggtctcatcagcacttataaacaaggtaagatttcttttcacttgcacagcttatctcttcttcactcttctcatagttggaaacatatttaactaaatggtattgacattttctccgcatgcttttcttttttcctatcacaacccttccatatactgagtatgtgcaaatgtgcaccatgttagccttgcaccaatcatctttattgttaatgttcatgcatgaatttctttttcttcctttcatttatagaattgaatgcagtgcaataccaattacaaatcccttgttttcagtatgtttttcttattttctagaacctggttggaatctgtattattgtcactaacgaattaataactgcttctttgaacttcttaaggtggatgtaacagtatcagttataaagtttcttgggagaattcgtttgtaccattttgttttatggaggcaattaagaaactagttgcatacttgcatgatatgttcttaggatatcaaggttctagtattttcttatctggatatttcttccttcgatacttcttttgggggataggggattatataatgccatttttctgcactccaggttgatgcaatgctccaagaacttgaaaaggagattgatgatgtagatgctataattggtaactgctggcagctacttgacaggtaattattctttgctttttgttttccttttttgcatgcgttgtgggttttaagatggaaaaataggcttgtcccttccattttttttaagcagatctgagtggcatgtaatatttacaacattgcaactacggtccctattgccattactaccccatcattcacacctatgtggccatctcttgtcccagtgagcttctataaatcctttattatcttgtgtcctgctattcagttgttccacaacttagtcggcctatctactaaaactttattcgaatttaaaacaactatatttgttgtttttggtgttatatcatgaatattttatgcagattcgctttttccctcagacactctatgctacttcagaccatacatggctgtagaccaagacactttttaattttgcctctttggtttttcttcatattttgttggttgaattgatatccttttggcttcccaggtttggaatgtaactgatgatttctttttttccgtatttgaaatttctcactctatgaagtactctgttgcttatattttagtgatcatgatggcaaagtgacaccagaagaggttgcagctgcagccatgtacttaaaagacaccttagacaaggcggatgtccaggaactcatcagcaacatttctagggatagaggttgattgctgaatacttggcaaattttttcacagttccatttaaattggtttcgcttgtctagcttctgaatttatcataatagcacattgatcatattttcctcttctaatttttattttgacagaagggaaaattcttgttgaagacatagtcaagctaggcagtcaaatagatgatgccaatggagatgaaacagaacttcagtcgttggtaatacaattgcggtttcttatgtaattttcagataaccatttttttattccgggtcaaaattttggtggcctggtcaaaataacctatgtatatatgtggttatataagatagttagtgctcacgtatgttctgtatcaatttatttgtttgcactttttgccctgtccagtttactgacctaaatgtgatctatattgtcaagcttactttggcaacctattgattctttatgcaatggataaaggtcgtatcttttgctgttgttaatgcaaaatgtggtccagtcctcgaagagcttgattcggttctccctcttggagatattatgtagtgaacccatgttcagtttattcatctttttatttttatttttttctaggggccccatatttattgcatgcattgtagctgttagttgttttggctgattagctaacgatatccccacatgggcatcgccttctgaagttttattgtgtcagagtttggattgtggcttcagatcatgtagcagagttctatcaaaagatttgacctgggggttccaccatttgcaaagtgtcaactcttagatcagattcatgcagcattttgttagcgtaattctcggagtgccgtttctgtccaatgtcttttggaagtctggtattttggtatctgatggttcttaactaatgactgaaattgacggagaactataaaattgcagtatttttgtttaacaaaggtataattgattctattgggttttatagtgaatggctgtgtggatctttagtcttttctcctttacgagagttcttctttgaggctttggagatatgccggttcagcatgaccctacatttatttgtgaggcttctcgaatcagtttaggggttttggttctcattattcggtaaccaacccaaagttttctcccactctcattacaaatagaatgagcaaggccacgacggaaagcttcagctctcgccacgccaagaacgagactcgcaggcattaagcttcagttaagcattatagctgtgggctttgacaagcatctcgtaatctcttttccgagagtagtttgtctcttttctgtattcatctttcgaccttgagatttgaaaaccagtccatcttgtggttttgtactccattccaattcaccagtgttaactagcagtgggttggtggattggtcttcttgtgctctccattaagaatttcctctcatccgttcgctttgtagttctttcctgtttgtctccctaggattccaactgaacaggagattcgctctctattaaactggcattcagtcattttcctttgaatgtatcataattatggattgtcgtccctttgattgtcttctttcaagttgacattcttggaacaagactccattttagttactatgacgttgctgagttaggatgtcggaatggttcttctatcattctttggaatgatttatagcgttcctctagttggtctgaaaaaaaaaaaacataatgcaatatgggctgtataacacatattagacgataaaaagaacggctagttggcagcttgcgcggagtctacaaaattgcgcatccaatgtatagctgataaacgagatgtagcttgatctccattccaaaaagacgcgagggttatgtagtatgagctacaaaatgtgcacccgaattttttttttttttttgctctcttaaaaaaagtgcagatggtgaccaatttaccatcagtgtccgaactataacactttcttggcattctttattgacataaattaactagattcctattcaaatgtattcaaggaacaaaaataataggtaattaactgctggtcccttttttgacttcattctaacaaaatatttttgttgaccaaaacttttaactcccgtccattcttttatactacagtaacaaaacatccttttgacgtcatcttattttaaaaaatatcgaactttccctttactttcatcttcctttctcttttttcttcgttcctccctttccttcaacataaaagagaaaatggactccgctgctctcactacaaggcttctcaacttgatctctaaccctagttcttcttctttgttcttctccataaggtgtcggccatgttggaggctgctctccctcaccgtatgctacttccagaccctcaaccttgctcccaccccttccccaagcttggctctcttctcgcctgctctaccatctctacctaggaggccctcgtcaacctccctggcctctgcctctgctgcctcgttgatgagttctggtccatccccgagctgattgatcgctccacgcacaggccgtcaaaagaagcctcctttgtaatgtttttgttcagagatcttttattcgaatgtatgcaaagtgccttgcttgccatgatgctcataaagtgttttgcagaatgcaacatccagatgttgtttctcagaatcatttgaccatcaggtttataaacaacggcgatttggagattgtgcggaaggttttcgatggaatggctaagagatatagtttcttggagcattatggttgatgggtatgcgagatatgggctgaaggagattgctcaggacctctttgatgcaatgcccaagaggaatcagttttcatagaattcattgatatttgggtactcgagatgtggtagcgtggaagttgctaagttaggatgtcggaatggttcttctatcattctttggaatgatttatagcgttcttctagttggtctgaaaaataaaaaaataatgcaatatgagctgtataacacgtattagacgataaaaagaacggctagttggcagcttgcgcggagtctacaaaattgcgcatccaatgtatagctgataaacaagatgtagcttgatctccattctaaaaagacacgagggttatgtagtatgagctacaaaatgtgcacccgaactttttttttttgctctcttaaaaaaagtacagatggtgaccagtttaccatcagtgtccgaactataacactttcttggcattctttattgacataaattaactagattcctattcaaatgtattcgaggaacaaaaataataggtaattaactgctggtcccttttttgacttcattctaacaaaatatttttgttgaccaaaatttttaactcccgtccattcgtttatactacagtaataaaatatccttttgacgtcatcttattttaaaaaatatcgaacttaccctttactttcatcttcctttcttttttcttcgttcctccctttccttcaacataaaagagaaaatggactccgctgctctcactacaaagcttctcaacttgatctctaaccctagttcttcttctttgttctttttcataaggtgtcggccatgttggaggctgctctccctcaccgtatgctacttccagaccctccaccttgctcccaccccttccccaagcttggctctcttctcgcctgctctaccatctctacctaggaggccttcgtcaacctccctggcctctgcttctgctgcctcgttgatgagttctggtccattcccaagctgattgatcgctccacgcacaggccatcaaaagaggcctcctttgtaatgtttttgttcagagatctcttgttcgaatgtatgcaaagtgccttgcttgccatgatgctcataaagtgttttgcagaatgcaacatctagatgttgtttctcagaatcatttgatcatcaggtttataaacaacggcgatttggagactgtgcggaaggttttcgatggaatggataagagatatggttttttggagcattatggttgatgggtatgcgagatatgggctgaaggagattgctcaggacctctttgatgcaatgcccaagaggaatcagttttcatagaattcattgatatttgggtactcgagatgtggtagcgtggaagttgctaagttaggatgtcagaatggttcttctatcattctttggaatgatttatagcattcctctagttggtctgaaaaataaaaatataatacaatatgagctgtataacacgtattagacgataaaaagaacggctagttggcagcttgcacggagtctacaaaattgcgcatccaatgtatagctgataaacgagatgcagcttaatctccattctaaaaagacgcgagggttatgtagtatgagctacaaaatgtgcacctgaatgtttttttttttttgctctcttaaaaaaagtgcagatggtgaccaatttgccatcagtgtctgaaccataacactttcttggcattctttattgacataaattaactagattcctattcaaatgtattcgaggaacaaaaataataggtaattaacttctggtcccttttttgacttcattctaacaaaatatttttgttgaccaaaacttttaactcccgtccattcttttatactacagtaacaaaacatctttttgacgtcatcttattttaaaaaatatcgaacttaccctttactttcatcttcctttctttttccttcgttcctccctttccttctacataaaagagaaaatggactccgctgctctcactacaagacttctcaacttgatccctaaccttagttcttcttctttgttcttctccacaaggtgtcggttatgttggaggctgctctccctcaccgtatgctacttccagacccccaaccttgcttccaccccttcctcaagcttggctctcttctcgcctgctctaccatctctacctaggaggccctcgtcaacctccctggcctctgcctctgctgcctcgttgatgagttctggtccatccccgagctgattgatcgctccacgcacaggccgtcaaaagaggtctcctttgtgatgtttttgttcagagatctcttattcgaatgtatgcaaagtgccttgcttgccatgatgctcataaagtgttttgtagaatgcaacgtccagatgttgtttctcaaaatcatttgatcatcaggtttataaacaacagcgatttggagactgcgcggaaggttttcgatggaatggctaagagatatagtttcttggagcattatggttaatgggtatgtgagatatgggctgaagaagattgctcaggacctctttgatgcaatgctcaagaggaatcagttttcatagaattcattgatattcaggtactcgagatatggtagcgtggaagttgctcggggcatctttgaccagatgaggctagagtggagtgtgatcacttagacagctatgatctcgggatacacacagaatggccggttcaaggaagccttggaccttttcctcgagatgcaaattgcaggtgtggcaccaaataaaatcacgcttgtaagcattcttttagtggttgcacaacttggtgctctcagtcaagggaggtggatccatgcttacatggatagatgggtatggaagtggacttgatccttgattcggctctagtggacatgtactcaaaatgtggctgcattgaggatgctgctagcatctttgaaaagctcaagcatagagaattatcagcttggtacacaattaaattaacatagtatacagttaactaactatggtacacagtcaaataaatacaatacacagttaactaaatatggtacacaattaaatgaatatagtacacagttaaatgaacactgcacatagttaaataaataatatacacagttaaagtaacatgatacatagttaactaaatatggtatataattaaatgaatatggtacacagttaaataaacactgcacacagttaaatgaataatatacacagttaaattaacatggcacacagttaattaactatggtatatagttaaataaatatagtacacagttaaataaatatgatacacagctaaataaatattatacataattaaataaataatatatacgttaaattaacatggtatacagttaactaaatatggtatatagttaaattaatataatacatagtcaaataaatactatatatagttaaataaatactgtacataattaaattaatatgatacacagttaattaattatggtataaaattaaataaatatcgtacacagttaatttactattgtacacagttaaatgaatattgtacactgttaaattaacatggtatacagttaaatgaatactgtatacagttaaattaacatggtatatagttaactaactatgatatacagttaaactaatatggtacatagttaactaaatatgatacacaatttaataaatattgtacatagttaaattaataatatacatagttaaattaacataatacatggttaactaaatatgatatatagttaaattactatagtacataattaaataaatacggtacacagttaaattaatatggtacatagttaactaactatggtatacaattaaataaatataatatacagttaatttgctactgtgtataactaaattaatatgatatatagttaatttactaatgtacatagtggtcatccattagataagagatggggtcggcaagatggccgaaggcaaggccgaggagggcattgtcggcaacaatggtgatagtatatagttaattcaccattgtacataattgacttactaattaacatggtatacaattatttaaccactgtatacaattaaataagtacgatatacagttaatttattattatacataaataaataaatatgatacataattaatttatcattgtgcatagttaactagctactgtatatagttaaattaatatggtgcatatataattaacttaccactatgtatagttaaataaacatgaaacgcagttaactggccactgcatacagttaaattaacatggtacataattaatttattactgcacatagttaaattaatatagtacatagttaatttactactatatatagttaatttatcactgcacataattaatttatcattacatataattaattaatttttttaattaatttattattatttttatatagacacgtttctccgtttcaatcctcctcccatcattttatcatacataaagaaatggaaagaaagtatgatattaaattgaagatatttttgtctcgtgaggggtaaaagttaaagtcccattaaaaatagatcgaaagttgtataaaaaatcaacaagatttaaaaattaaagtttgatcaacaaatggaccggacattaatttttttaaaaataaacaaacaagcatggaatagtcctcgtaccatttgatatttcaaaagcaaataagcaatagcacaccgaagttataacccaaagatatagagcaactagtgcagacagcaatgattagccaatcttgaccatagcaatgcccagtttaccactttgaccaatacttggccacaaattctgtgatattcctatctgagcttgcaccctcccccactggccttttggccaactcccccaacttccttgcattcctcctaatctcctcactcctctgcccctccatcaccaccctcacacacctctcacctcctctctccccaccaatcccttctcactggccctcacccataccccaatcttccaaacatcctcaatatacttggcattcattggctgatctgtccattgtggcattccaatcatcggcacgcccaagctgatctcctctatagttgaattccatccgctatgtattagcaaatagctaactgcctcatgtgatagcaccgtcatttgttcgctccacaaaaccaccaacctttgctctgatgacaaatcttttataaagttttttgggagtttggaggcttttgaggatttcaccacccaaagaaagtgtttgccactgttgagaaggccgaaggcgagctctaccatttgatcgggcccgagtgtgaccatattgccaaatgatacatagacgacagagttggagggctgagagttgagccattgcatgcagagggcgacactcggactgtaaaggtggaagccatagtgagagtcggatgggaacaggttatccaagtatgaagatggcatggtggggcctatgatcttggcttgccatgtggacgccatgtagtcagcttcctgcttaaattttcaacaataagaaaggttaatttttcttttttacttctaaaattataattaagggtttgtccagacctagcttagatgcttttctttgggttgcaagaagaagaaaaagactcacagaggttttttttcttcccataggatttacattggatgaagatttgttgatacaaggttatgcttaaatggatggctcgatgcatgaatgttataggattttcaatccacccctgcagaaatacccaaatagacaaggaaaaggcccaaaatatattattagattcaataaaaaggaaaaaaagcccatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttactcgatcatgatcagggtaagttttgcctcgcctccttcctccattaccgtctttattatttcgtctttctgacggtcagttcccgtttgcagtcgatttacactatgtccgaactagaggccggataccggaggttcggggatgttcgggcagcccggaaggacaaggcgatgaccgccaaagtctaaaaggcggtactggtcgagcagttgaagctgtcgaccgatcgggaggcgaggcttgaagacgagatctctcatctcgaggccaaacttaagtcagcccgcggggaagccaggcacaagggtcggaccgctcactgactgtggcacgagcgggacggcgccgtcgtcgaactcgaggccgaatgcgagcagctctgggtcagcctggagaatctcgccaaggccgaggaggacttgtcaatcacccaagcctacgttgacatagcgaaggcggaggcagagtcggcgaaggagtcgttcgatcgggcggaggcagaggcgaggtcggcgaaggagtcattggatcgggtggtggaagactttcgcggctccgacacatatcgggaggaactcctgggaagtggcttcgcgtcgtactgggtggggtacgaagatgctcgggatgcagtccaggccttgtacccggagctcgatctcagcggcattgtccccccgggacccgaggaccaagccacagaagaggtggccgacccatcgtcaggagacgctactgtggtggaggaaaccgtcccagagcaaatcaccgaagaggagacggctccgacctccgacccagctctgacctccgacccggctccgacctccgacacagcaccgaccagagtggatacaccggccatccccgagctcctcccgatcgaagaggtcgactccgaagaatgatcggagtgttgtcactttttgcttcgctttacatacttgtaatcgggcttcggtccaattttgtagacttgatgaaattaagtattttcaacttcttcacttcgtatgttcagatgcgctctgacttagagtcgtagagtcgtagacccaacatgccatgttaggtcactcggtaacatcctaagtcgttagtcgtgatagtcggtaacgcgcgccatggaaaaggcaaagtaaatttcaattacagaccgtccatccggcggtcgtggtgtgcgcccgccgttggcctgagctgaacattccttcgcccggttgtgagtcgaaggttaaagtcgaatgtgcgtcgtcccgacatgagttgggcacgttcgttgagtcgaaggttaaagtcgaatgtgcgtcatcccgacatgagtcgggcacgttcgttgagtcgaaggccgaccgaccttcgggcacacctcgatgacccgatcattgcatagggtcgaatgttgtctgatgtgatcagtcggatggcgtccgacacgtttagtcaggaaaatgatgacaagtcgagtttccattacccagacctaggtcgggtacttacgtcgcaccgtgtgataaacggtggtaagtcgaatatccttcgaccggctgtgatctggtcggtaagttgcgaacgcgacgttggtcgcgttggtgctttgcctttctcggtcggggccgagtcggcaagtcagccgatcattttgcccgatcgttttaactgtagaaggagtgtaactcccatcgtcgtggatatatcagtccttttaagcatccgatgcatcgtcggcgatcaggccgttggtccccagtggaacgttaggctcaagtcgggacgtcggggctcgtacttcctggcgagcgccgacccacagtcgaagagtcgagattccagactccgagattttgaaattgaatttgtattccaagtgaggggatacaaagttcattggtagtacaactttaggttgtcggcattccaggtccgaggaagggcgttcccttctagagttttcagtcggtaagctttcggcccgtaggcatccgccatcttgtagggtccttcccagtttggagctagcttccctcggtctagaggcttcgagacttctgcctttcttaggactagatccccagacctgaaaagctttggtttgaccttggcgttataatattgggccaccttttgtcgatagaaagccatacgaagttacgcctcgcgtcaaagttcggacaagaggtctaagttggctctccgatactcggagttatccggctcacgatactgctcgactctggatgatggtaacccgatctccagcgggatcatgactttcgttccgtaggctaagttgaagggagattctccagttgggatacggggcgtcgttcggtatgcccacaggacagagttcaattcttcgacccataggcctttggcttcatttagtcgggtctttagtctgtgcagaataattcggttggtcacctcgacctcaccgttggactgtggatgcccgaccgaggtcagtcggtgcgtgattcgaaatctcgcacagaagtctctgaagtcttggttgtcgaattgccgtccattatcgatgataatggtgtgcggcaatccgaacctgaagatgacggacttctggacgaagtcctccatcttccgctcagtaatttgcatcagaggttcggcttccatccacttggtgaagtagtcgatcgcgacgactatgaacttccgttgaccggatgccggaggaaaaggtccgagtatgtcgattccccactgggcgaagggccacggggcgacgactggattaagctggctggcgggtcggtgttgtatgttggcatacctttggcacggttcacacctccgaaccaattcagccgcatccttcttcatagtgagccagtagtaatcctgttgcaggactttgtaagccaaggatttgccccccaagtgattactgcagatcccttcatgtacttctctgagggcatagtccgcgtcggtcggccccaggcacttcagcaagggaagagagaacgatcttttgtatagtcagccatccaccatcacatattgggaagccgcccaccagagtcgtttggcttccgcagggtcttcggggctagttccgtcggtcaggtactgagcgatcggatccatccaatttggctctgtcgccaattgcagcacctcttcgatcttgtcgacgctcggttgttccagactttttatgaatgtccgactcaaggtgccgtagtcggatgtcgcgagcctggagagtacgtcggcccgagcattttccgccctggggatgtgaaagatctcaaagtatttgaagggtgctacgagatcttttactttttggtgatatttggccatgatcggatcccgcacttcgaactcacctttgacctgtccgacaatcagttaagagtcagagaagactttgaggcagtcgaccccgagctccagtgccaacctcaagcccgcgacgagcgcctcatattcggcttggttgttggaggccttgaagtcgaaccggagggcgtgctcggtaaccactccctccgagttggtgagcaggaacccagccccgctccctcgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagttcgagtggggaacctcatcagttgtatttatgacggatgaatatgagagagataggacgaggtgggcaagacttgtggtgcacacggaaagggggtcgagttacggagagaggcgcaaaagaacgtgcaggagttgcggtggccaaagaaagagactaaagttacggagagacgtaccaaggagcgggttcattttgtttatcctctagcgggaaatctttgtcttgacactcctcacatattttgacacatttacatgaggcaaatacgaagaagtccatacgtaattaaaatgctatttttgtgattaatgtttgttgaacgatgttggactagtattcctctctcacgctccgaaccaatcactttggccgatcacatgacgtggccgcatgagtcttaagagcaattaacgtcctgcaggtcatgcataattacaagagagtgatcggaaagagagagatcgggggagtcgaagaatgatttgcattatggataagggagtggaagagagagataagatatatcgaaaaatttcttacaagcaaagggattaggacaatctaaaacaaaagagaacgatggtgtgcaaaaagaggatgttcaacaagttggataagctagtttcgagcaaaatctgttaagctattattcattttagagataaaaagataattttataattttaattaatttttaatttaaataaatataattttggctagcaacgtcatcaactaaaccatcatatcagggtattcatgtgcaatagcattttgaggatatacaaatatcaatttagaggggtattcacataaatttcaatatgtaagggatattcatgcaaaaagtacaaggatttttttcttatatatatgctcctaaatatgcgaaattatatgaatattcttataaagttactttttgcatatatactcttataaatatttctttttgtatatatactcatttaggatatttcagtcattttaattttaatccactgatttcttaatgacattacatagcatatgcacatattaaagaaaaaaaaaggttattcatgcaaaacaagtattttataaaagtatatatgcaaatataaatttgggaggttattcatgtaaatttcaatatgtaggatggtatgtatgtaaaaaattttaaaaataaacaaaaatgcatggaatagtcagatgtcccaaaaacaaataagtaatagagtaccgaaattataatcaagagatatagaacaactggtacaaatcgtagttacaattagccaatcttgaccaaaacaagcccagcttatcactttgagcaataattggccacaaattccatgatgttcctatccgagcttccaccctcccccactgcctttttggccaactccctccacttccttgcattcctcctgatctcctcactcctttccccctccatcaccaccctcacacacctctccacctcctccctccccaccaatcccttctcattggccctcgctcgcaccccgatcctccacacatcctcgatatacttagcattcatcggttggtccgtccattgcggcactccaaccatcggcgccacacccaagctgatcccctccacaatcgaattccatccacagtgcatcaggaagcagccaattgcctcgtgggacaacacctctatttgtgggctccatgaaaccactagccctcgctccgaggataaatcctctatgaagttcttagggagcttagaggtttcggaggatctcaccacccaaaggaagcatttgccgctgttgagaaggccaaaagcgagctccgccatctgatctgggccaagcactgccatactaccgaaagacacgtagatgacggacttggagggctgggaatcgagccattgcatgcaaggggcgatgcttggcttgtagaggtggaagccgtagtggaagtcagatgggagccgattgtccaaatatgaggatggcacggtggggcctatggtcttggctcgccatgtggatgccatatatccagcttcctgcttaaattcccaacaataggaaaggttaaaaattctttctaattttaaaattaaatataataaaaaatagaattaattttgagactatatcttaagttttattattgtagctactgtagcatcccatatgaatctggagaattcagacttatatatcgtatttatttcatataattgatttccttcatttcattgaatttgattttgccgtttgagcctaatccattctgtcaataagatgatgagaaaatgatcttctcaagagatacagaaatgctcacttattatctcaaagagaagcaagcagaacttcaagcttagctactacttgctaattgctgattcaaaattgatttaccatgcatggtaccggctctattgcgacgtgttgaacgggaccacataaaaaagcaagaataaaagtccacaaaagtaatttacacccaatcatgatggtgaaaggtaacaacgccataccagcaaatcagtcgccaattgcaatgtggatgacggaaagaatgaaagctaaaaataagtcattcatgtgttgaagatatatggctcgggctaccttacacaaccatatcagtgaatgaatactttttatcaacatggcaaagagagccgaggagaatatatcccaagctgtcacaggttatcccaagccaattacaaaattgagctaccacaaaaaatggctatcgcaagtccatcatccagaaaaatcgatagatgacaaagtcaacgaattcacaatcatgacagcgaatctaaaattgaaatttagcgactaaggtagtatattcgtgtcaagagaaccactggaaaatccagcaacatgaatagaggcaaagcacgagatagaatacagagtgaaagtccactagtggtacaaaactgagctatactagaattggctcgactctaaaatacttggagttagaaattttggagaacttaattagttatatacatggctttcagccgcaacaaattgtttgactgtcacctaatattttatctctagtaagacaaactagatatatggtatggtgctggacgaaaattcgccaataattgggccgggattttatatgcgaggcaaatgccgagggatgatcatttcattatcgaaggtggctcgaccatggtggtaatctgaattcagttactgcactcgagaaggtcatgttcgtcctcttcagaaagatatatttatattattaggatgttgtatgcgtgttattaggtatattttttggaaagtagatgctacggtcgactggatgatagtttttattgcatagcatttgggaggatctttttgggttgaaggggtataattcttgatttttttaaaaatattttattttctaatttttttgattatatttatattaaaattttatcaaaaaaaaaaaacctataacaagtcatcaactaggcatatttatataggatggatgctagaattttttttttttttttaatgatgaacgctacaaaataatgttccaaaatttgttataaacaaaaagaaaagtaaacgtgtcccaatctttgccaaacaattgcactaaattaggaaacatgctgccccacgtcctataattccaaatacattgcatctgatgacaataatgataactcccctttctgtttgttatgaccctgcccaccataagcgtaagcagtatccttatcctcacttttcaccgttgggactcgcttttcagggttcccaggtcaagatagaatttgtacttcactggaagtaattaaaattcgtactgtaggaaaaggaacaggctctgacttgatccagtggaactcttcttgattattatggggcaccggtctcttgaacatttacagttccctctgccgcatggtaaaagaggcttcgtgtaacttttgaaaattaatatgatgcatggaaaaggctcaaaatgttttttaggttcggtaaaaatgaagtccatgatgtacagggctaactcgcgttcattatccaacaaactcctgctcatctctgctctcatattgaatccttaacaactcaagctataagatttttttttcttgttttttttttttaaatggttctatctctctctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatcaaattaataaattaattcagccatagattcgatcaaatcaggatcatttctcctttatcgattaggtcatctcataacctaatcaaacttgacctgattgaatccaattcaatcaaacttgatccagaccttaatgctcaatcaaattgagctaattaataatctaattactaattaatcttccattaataatagagtccaagtcttataggatttttctctagagtctccatccagtaggactcttcagcagagtttccatccactgggactcttcagattagctatgtgatcggagagaaacttctaatgtgtgtgaccccataggttcgaacttaagccggtagcacagaaactaatttttgtaccaattggagtaaccatctagcaagggtgcccgacgttcggataggccgaatatatgcgaagcaacactcaagagtctatttgaatatagttaccatataattcatccctttgatccttgatgctaggatgacttagagtttaaactgtcaactcgtaatagtacatctattatgtatctcaatctaataaattctgtgactcctcataaggattgtcctggccaaggtcttactcaattgaaacacaaagcattctctccaatctcttgaagtactcaattctatcttgactcacgcaccgacttcacaagtacttgactatgcctagaaacctttcgatcctgaattaaaaattcaggtagtccggcatcaaagcacagtgagttgcttgcaagttaccatggtgatctcagatcagaggaacacttatacccatatcccttcgggactcttgacagcagaatactccagagttgatcacgtttagtgaaatatactcctacattttatctgtatgccataccagcgtctccacactccttgattaagaggacgaccaatgatatatagcacacaatgatctatacttgatatatctatcatcctagtaatagcatattatttgatcgcgaacttatttaaggactaaatgataaatcttcttttatcgatttaaaatagtctcaagaactttcattataacacagacgttcgatatagaagatgtacaagcttatgataaaaattatcaaataaatattttattaattaattcatatacaattacatcaaatagtacaatcgtcaacaggttgacgattgattttgggacatatttttcaataactctcacttgtactaaagtcaattggtacagtatcgtatacccatcttcactttatgatcttcaaactcctttaccataagggctttagttaatggaccggtcagattctctcttccatcgatcttctgaaggtcgatatcacctcgatctatgatttctcagatcagatggtagcgatgcagaatgtgctcggtccgctgatgtgactttagttcttttgcttgagcaataccatcagtgctgtcatagtacaacaaaatgaggccattaagggagggtgccactctgagctcgttgataaattttcgtaaccacacagctttcttcacagcatcgaatgtcgtgatatatttcatctcgtaagtagagtcggccacagtatttgcttagaactcttccagcaaattactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatagcctttcttagaattctccatgctgaacattttcagcacagtatcaatgtatgtcgactgggataatccaagcaatcttttagatctatctctatagatcttcatcccaaagatgaaggatgcttctcccaaatccttcatggagaattgagatgacaaccaaatttttattcctgataatgcagggatgtcattttcggttaaaaaaatatcatccacatacaaaataagaaatactattattgagttattaacccacttgtatatgtagggtttctctctattcttaatgaagccagacattttgatcactttatcaaaatacatgttccaacttcgatatacctgcttaagtccataaatggacctctgaagcttacacacctttgatttatctgtggatatgaaattttcagattgtatcatatacatattttctttcaactctccatttagaaaagttattttcacatccatttatcaaatttcatagtccagatgtgctgctatcgcaagcatgatccgaatggacttgagcattgccacaggagaaaatatctcgtcatagtcaataccagaatgctgacggtaatctttgacaactagacggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttataggtctccacctttccgtctgcgtccctctttcttttgaagatccacttttatcctatgaattttatcccttcaggtaggtcaaccaatatccatacattgttgactttcatagactccatttcggatttcatgacttccaaccacttatcggagtcagacttctacaccgcatctatataagtgatcagatcctcattgttctcgtcgagttcaactggatgatcatctcggactaagaaactgtagtatctatccagttgacgtggtactctaccaaatctacttaaagatatttctacaacagattttggatttgatctaatcaaatccaactcaataggtttactagattgtgtcggttcttctaccgatcgaacttcattaagttcaatctttgaggtattagttccttctccaagaaactccttttctagaaagattgccctattactgataaatactttctgttcgtcaccaaggtagaagtaatatcccttggtctcttttgggtaccctacaaatagatacttgtcagacctagatccaacttgtcaattttcagacgtttgacataagccagacatctccaaactctaaaatgagagaatgcgggtttacgtcctgtccatatctcatgtgatgttttactcacagacttactcaaaattttatttaaaatataacaagccaactcgagtgcatatctccaaaaagagatcgatagacttgcaaagcctatcatggattgaaccatgtctaatagggttcgatttctccttttcgatacaccattatactatggtgttccaagagagatccattacgagagaattttattctcttctaagtatgtcaaaaactcactagagatgtattctcctcctcggtcggatcgaagagttttaatactcttctcagtttatttttttacttcattacgaaatcgtttgaatatttcaaatgattcttacttatacgtcattaagtagacgtacccatacctcgatagatcatctataaaaataatgaaataataatatccacctctgacactaatgttcatcgatccacatacatcagtatgtatcagacttagaacttcactagcttgctcatctttttcagtaaaagatgacttgatcattttttcaagaagacaggactcacaggttggaagtgattcacaatcactgacttcgaggatctcctcttgtgtcaacctatttattctgttcttattaacataacctaacctacagtgccaaagatagttattggagacatcactaattctagaacgtttgctagacgtgtacattacactaacaggttgtgacaatatgtaaatatcattgttcagctgtccattcatcacattaacaccattcataatgatattaaaattatttttttattaaaatttcataaccatacatgaccaagagatctacagaaataatgttcattcactaagaacaattgtatttgacttaaatacaagcttaataattcctaacgctagaactggaactgatcttccatctccaatattaaaaaaattttcaccttcttcaaatctctcactgacttagagacgttgcaacgaattacaaatattaaaaaggcttccagtatctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtgatctaatcactaattaatccttcattaataatagagtctaaatctagtgggactcttctctagaatctccatccaatgggactcttcagtagagcccccatcctccgagactcttcagattagccatatgatcggagaaaaacttctaatatgtgtgactctataggttcgaatctaaatcgatagcacagaaactgattcttgtaccgattggagtaaccatctagcaatggtgcccgacatctggataggccgaatgtatgcaaagcaacactcaagaacctatttggatatagttaccatataattcatctctttgacccttgatgctaggatgacttagagtctaaactatcaactcttaatagtacatctattatgtgtctcaacctaataaatcctgtgactcctcataaggattgtcctgatcaaaatcttactaaattgaaacacaaagcattctttctaatctcttagaatggtcaattccatcttgactcacacaccgacttcacaagtacttgactatgtccaaaaatctttcgattctgaattaaaaattcaggtagtctaatatcaaaatatagtgagttgcttgcaaatcatcgtggtgatctcaggttggagggacacttatacccatatcccatcggagtgactcttgacagtagagtgctccggagttggtcacgtttagtgaaatgtacttctatattccacctgtatgccataccaacgtctccacgctccttggttaagaggacgaccaacgatatatgatacacaatgacctacatttgatatgtctatcgtcctagtaatagcatatcatttgatcgcgaactcatttaaagactaaacgataatcctcttttatcaatttaaaatagttctaagaactttcatcataatacagacgtttgatatagaagatgtataagtttatgataaaaattactaaataaatattttattaattaattcatatacaattacatcaaatagtacaaccgtcaacgggctgacgattgactttggaacacattttccaacagaaggggagacagagagcactatttcacagtaaaagaaaggagaaagagaggaaaaagagagaaaaagagagatggaagaagataggagggggatgatggatcctactgtttgggagagccatccgattgttgaagagcagccaagggagtgtggacatttcatcaaaggcagaaatagaaaatagggcctgttgctactgaaaagagagaaagaaagggacagatacagatagagaaagagagggggagagtgagatgaatccagtagccaaagatgaatggccgcatgccatctccttgcaagatggtagaataaaggaaagggtgggggggtgagactcttgaaaggctaaagaatgggggagaaaaaaaaggaaaaagaacaaagaaggaagagagagggagaaagagaatttggatagaaaagaatagtggaaagagagaaaggcagagggggagggtggaggaggtgcccgacgaggagaaagaagaagagagagagagaaaaagaggagagaagaagagaagagagggagactagaggagtaagagagagagaaagagaggtaaggggggagagggaagaagaaatgaggagatatgcggtcgaccgactttggctagccaatggcagaaaggagagagagagatagagggagaggatgggggagctaggaaaagaaagggggaaggagagagagagaggggagaaagaggggcctgacagccggccactagagggagagctttggttggagaggtgcttgaggtgttcgtcgtgaagaaaaaattttaggacttctctctctaaaaaggcttctgatgagttgtatataattaaagtcatcacggctgaaaataatatatgaacaataatttttcttaagtaaaatgggttggaaatatccatcgaagaaaatataggaagttgatatttatatgctattgccaagatatcacattatacctgatttactagattcaatggcaggtcattcaaatcctaataaccatggttcaacttacctcattaatttatcaatctactgattgattgatttacttctgtaaatctgatgatgtagatatgacatatgcacttgaactagtgctaaagaagttaataatcctactcaaatcattgttggcaaagatataattattcaaattaaatagacattgtgaattgattttgaaaatttgtatttaatataaaggatggcatagtgcataaaactatagttattgcaagatccagagaagatcagaattggataattaatttaaatttataaaaataatcaggtgatcatatataaacttataaaaataattattttaagccttaaatcaaatctaatatatatatatataggtctctatattggcagggcctccatttgacatgtagggttttgaaaaaaagaagaggaagccacgttaaaaaaatagctatcacctaggcttctctattcaactgcttcgttcgcttcaagccacccacccgattgagactcctgaggatgcctctccatcatcgatgaggatgttggcccccatgatgaacccgatcatgatcggtacaatcgttctgaggttgagagcgtacatgtgtggagaggggacgagggcagaggaggtaggaataaggagaaggtggagtcagtgagaacggggagggtgctacagaggaagctgatgagcttgggcttcgtgatttccatctaggttatacagacagctgttgagaacaggatactactggccatctatgatcattgcttgcatgcaatatgtcaaaaaatatctaatctatcagatacactcacatctgtcgcatgtgccgaccaaaccatcccattaagtcttattggccgttccaatgttggggactggacctaatcgagaaaaaaataagcctttaagttgggtcacgcatggatcatcaccacgatcgaatacttcacaaagtgggtggaggctgctcctttgaggaaggcgaccccacacactggagctccctcgagccctccatggggtccactgctcctcctctgatggaatccaagaattagagtttatagtttggtgccaaagtgtcgacatggatactagcacccatcggaggctgggagctctgatgtggatcatcgattcggtatgcattattgtagattttttttctccctatattttttcgactgatgagatgtggaaccacagctataatcaaaacattggacccaaacattctctgcatgatggatgcggtgccttccacgcgtgcgtgcatatagcattgtttgggtaaatttgtattagctcatggccttggtttgaactatttgattgatacaattaatttgttataaggatgaagaaagcagtaggggcatcgctgtggtggtggtggatgtggaagagggtttctcatattttgattgggttcttttctgaaggatataggattttgtgcgagttatggtggtgtaagttggtcccttttaggtttcaagagcttaatccaagatggtgctgaacatggaggtgaggcagaggcaaatgtgggtggtggagctacctcaggggaagcaaatgatcgtgctccatgttctagaagggtttcttaagtttcgattgggttttttctaaagggtatgggattttgtgtgagttgtagcagtgtgagttggtcctttgaggttttgagagcttaatccaatctaatgtaatatatctaacctttccccacttagatgatttttttcttttctttttattttattattttttttagagatatgtgagaaacgagagcacaatgagagagattagagaggtctctaaggttccaattgcttttttctgaaggatatgggatttgctgtgagttggtcccttgagattttgagagcttaatctaattatatatatatatatataaaataaaatggaggtacctgtattggcttctttctccaatctcccatgggtcagatcttcagaaaataaataaaattaaatattaattttaaaaaattacaccacataggttataagttagtattttatatatttgtaaggattttaagatttgaacaagcacacttcaaaatgtgccaacttcccgactgatgtgattggttaacttttttgtaaatttatgaattatgataacacatgatattccagttataatcatataagtataattatttgaaataatacttagtttaaattgtaaaaaccaaaataagttattttctcccaatctcccatgatgctatccatttgtccttcgtattcaaatagctatcaaatggcttaagagaggatgcaagcgtgcataatatgcttctatgattaatgctcttgcatgataaaactattggagaatctctcatgggtgcgaatccccatccaagaacgcaacatcgatgacgatgtcgataccacaagtcgaaggataaaaaaagaaatacaaaatacaaccaaataatatagattggctcgaggcctatctccacaaggtatgcaaactgctttatgagagaaatctacaaatacaaggtgagatcataaactctcaactctcgtacaacaatctctcaacatgaagtatacattcattacaaaaattctcaaaatccttaaagagacacttcagtcatcataaatgctaccatcaagtcgtagaattcatcgcaagctttttatagagcctaacaatacctaaaacggatcagaaaccatcaagttacactcatttaaactgaaataaatctcaagcatctaatcgccattatgatgcatagataccattgaacaccatttttttcagtggctcatgcatcagatccgcatctccacagtagtcccagcgcatcccaatcgccagccatccaatcgagccaatcggatggtccagaagcctcctacaacaaatgttggtccaatggccgattcagggcaccgtaaccagtccagcgactggtttagcaccaattcaagctggttcaacttgatttagctcggtttagggtcggcttagttggttttcagttggtttattgttagttcttcaccgattcacctcagaattgactggttcaccttcggttcgaacccaattgagctcaatcttgtgatttctctacctatccttgagtcttgggcctttattaaccaatcaagatcgaattgaaggtgtcaaactcaataaatctctacctcgactcaatattcggcctccacataaatttgagagcttgtggatgatctcgcccccatgtcctgggacaaatacctgactactcttggatggacagacataaaagtcgagtcagatcactcgatcccatctccatcatatgttgaaacctgcctgacctgagacatacctgtggtagcctcctgtggcaataagaatttcactttgcaatgtcacctatcatccttccaagccttctgtctcgtgcccaatccacctacacctggagctttatctcttgctgagctccctaccaaaagatagtatcctccacacttctttctcttcaatacaatcctactaccacgcataatcttcaggactctagcattagctctccatttgtagctgcttgaatttagtctactcagtaaaatcagattactcttgaaactggatatgcaacgaatctcacccaactttctcactgctccatcatgtgtatgcaagctgattatcccaatacctttgattgcacaactcaattcattcgataaataaatagtaccctcattgccctttagagagagctcctctctataacaaacatgatgtgagcaagctgaatctaaaattcactaaagaaaagaagtagatacctcatcaaagatcatatacaaatcatcatctcatcagtgtcgccatcatggaccaccacctacagtagccttcatctaatctttgagctatgaaaaatctctgactcgatgtcccaattcatcacaccagtagcatttgatcttgctcgaatccctcgacttggacctggaccgcctatcttgcgatcttttgccgccaaaatcaagttgctacctaaattcgagactcaattctcacgtctgagaatctcgttctgaaaaagtatagaagtgatctcatccatcttgatggtgctcttctctataaaaaaaacagtcactaaagactcaaataaagaagaaagcgacgaaagcaagaccaacatcctgatcttttcctcaatattctcaccaatactaaggagttcagtgaagaccttttagaagttgctaagatactcctatatgctttgcccctcgctcatccacaactggtagaactactttcagagaaagagagcattggtgagagtcttcaccatgtacatcttctcgagcttcgatcatatcgccgtcagagaagtctcattaagcacatggatcaccatatcatccatcaagtacaaacagatcatgctcaccatttgcatccaaagccacttccaatccttctcctctatggtagtgatttcttctcacataagatagcatcaatcaatccttgttggatgagcacatccttcatctttgcttgtcatagaaaaaaatactctttccatcaaactgatagatctctatcttgattgagcctatcttctccatcttttccaatctcgatcaacaccatcataattcagataaccctatgctttgatgtcacttgttgagaaatctctcacgagtgcggaatatggatctctatccaagaatgcaacgtcgatgacgatattgataccataaaaagaaagatggagaaaaaagtataaaatataaccaaataatatggattggctcaaggtctatctctacgaggcatacaaacttcattatgagagaaatctacaaatacaaaaagatattacaaactctcaactctcatatactaatctctcaataaaaagcatacacctctcacaaaaactctcaaaatcctcaaagagacactctaatcattataaactctaccaccaagtcatagagctcatcgcaagcttttgatagagcctaaaaatacttaaaacgaataagaaactactaagttacgctcatttgaatagaaacaactctcagtcatttgatcactgttctgaagcgccccaatcaccaaccatccgatcgtgccgatcggatagtccaaaagcctcccaccacaaattttggtccagaagccaattcaaggtgctgtaaccagtccagtggccggttcagcaccaattcagactggttcaacccgatttagaatcgattcagttggttttcagtcggttcttcactagttcaactggtttactgctggttcttcacctgtttaccttcaaattgatcgattcagctccaattcgaattcaattgagctcaattttgtgatttctccatcaatccttgagtcttaggcttctattaactaatcaagatcaaattcgaggcatcaaactcaataaaaactttagttgaatagagctagggaggacataccacaaaatggagaagtatttgaaacaaagaagagctatgaaaaagattctatgattaccaaaaaaacaaaaaaaggtcctatgcatgataatatctcagagcgatgcacttggaagacgtgttgagaaaaatatattcttttatttcaacctttcagaaaaagcaactctagagttgacgtgccttatgtatggtttattaagtaatgatactagtatgcgtacatagatatttaaaataccagaacttctcacacaaagaagatacaagtttagactatataattatatatcataattaatttataggaacaacaatatataatatgcatacatagatatcaaaataggatgaaaggtgtgattgttttaaatgaaactaagtggctcaatttcaaagttaaaacatcactggtgacaaatgctattatcgaaacataaaaaaagttatcgcgaggccctggacaatctaactgggacaacttagcagttgatatattttggcatggtaaagtaaacacaagtgcatttgctttccctattagaatacaccaccttagtaagctggatgaaaccaatctcatctacttctttgcgagaaatctcatcacacgaacattacaagatcgattttttataaatattgccatcactcttggcttaccgatcaattattggttggatatggtccatagtgtaccatagattatttaattcttcttcctccaatttttcttcttgacacacatcttatcatgcatttaatatctttttcgtcctaaacaacaaatattactgttgctgcgacactcaaaatctgagactggggcggatcggatgaagtcaagctggaggtcggtagcggtccaatctaaaacgcttcaaaaaaacctacaaaataaatcaaaaatcaagtgaagatcttttgattcttaaccttctgatgcttaagtcagtctttacccgagaacagtaggtgaaaaagaatagaagagcataagaagaggatttgcatggaactaaagaaattagactgaataggaactagagtccttattcaagaactgacaaagttttcactgacatagtctcactctgattttagaattagaattttaaacttaccattggaggatctctgatctctatttatagaggggttgatgagattgttatagagtctgttaggccattagaggagtttgttagacggttataggcagctataagtgagctaaagtatagctatatgtattagctagaagtgagatcatatatacttagctgcatgtatcagctggggatgagttcatacttagctatatacgccagtcagaaatgagttgtaacatagcgatagcaacctgaaagacagctataaaataaccatctatattttgagattatatcaattcagatcggtagatagctgaactgatcataatgcttcatcaggagtagattcaagttagctcagatcgatgtttagataaattgaattgaatcaaatcgatattctatcgatctgatccagaaataaattttgatcaatataattctcaaataattctttctaatattatcatgtgccagagatggatttatgatgatgttagatcgaatttatgatgatctcagcctttcgatgagatcagaattatgatgatctcaatcttcagataaggtcggctttatgatgatctccacagtcgagttttacatcagtattctcatcaattcgagaacttctgtgtctcgaggacatcagctgaggtgatttctgaagaagttgctttgaacaaaaaaagtagtctaaaaaaaaagttctcagcttgtctgaggtgatgaatccatgtcatttggttcaagtaaaccactgcatccctccacttgagatcgaagtgggcaagtcgggtcacttgcatataacttttgacctttagattttcctctttgagggcatatcttcctgagactatgactttagtcataagtatctttgaaccgatgttgcaaagtccagcccatagatggaggtgcttcacatcaaatgtttgttgaaaatgaagtattttaataagtatttgtatggtccaatccggagatcaggtgtctcatctcatctatgaggtagtgaggtccaatccgaagatcaggtgcctcacttcaagttatcctgatttggttgggagtattattgactttgatcagcttttcccaaccttgttcagacacttattcttttctttgtcctcgtttgataggagacatttgttgtgatctaagggtcgaatggctcggataattggctcatgcctccgcacctgcacgtaaggtattgtcctctttggccttgatcattttcgggcttcaataagcctttggcttcaatgggccatggtcattttgggcctcatggttttgccttacatgggaaagaaggtttcaattcatataagctaaactccctcttgactcacaaccgatatggaactaaactagctattccctcataataatatatatattggtttgttagacctctcatagcccgatctaagtttaactatcctatacaggacttgaaaattattcataaaaaatattatttgatctcgattgggtcagttataaagttaatgtgctcatcaagataagtaaatgttagaacattaaaataatctgactttaagaattagattggttaattaagaacaaatcgatactaataaatccaatgtgtatgatagacattttaagaaatatctctgtccgatgtcgtcgtggatagattggatcccccatatatcagatgattttctctttacaatatcttatcttcttcccttttaaggatacatcattcgagaatttgagccaaaacttgtcaagttaatgccttatgaggtcaaccttgaatacgttatagtcttaatcagaactcaggtccaatcggaacttcagattttgatgaggtccaagcttcaaggagccttgagcttcatcaatgtggtgttcatcttgatgaactggttgatggctatattgaaatagagccctcaggggagttacttctttttattgctatttcatatttgtagtctttctgaagagatcaatctccttctgatgaacccattcgatgagatcgacctcctgatgagatcgattttttgcagagctcgacctcctgatgaggtcggcttttttataagctcggccttttgttgagttcggactcctgttgagatcgattttctgctgcgctcgatcttttgataaggtcgactttctaatgagctcgatcttttgctaagtttgacctcctgatgaggtcaattttctactgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagacttagataattatatttataattaactattgcggtcaaaggggttagatagctcagatgattgggttaactctactcttatatatataaggtattgtccgttttggcttatgaccatctttggacttcagtgaaccttagactttagtgagtcttgatcatttggtgcttcataattttatcttttatggagagagaaaatttcaattcatattagtcatacttcctcttaactcagaactgatttggatctaaagatgccatccccttacaacataaatattatctgaccttgattgggtcaatcatgaagcctatatagtttaatataataagtaaacttcaaaatatcaagaatgacttaattttaagaattagatcgattaattgagaacaaatcaatcttaataaattgaatgtaataaaggtttaagaaatacctgtttgatatcgtcatgggtagatcgagtctcccatgcattagatgagttttatcttgagatatttcatctcctttccttccaagagtatgttgtatgttacggataaaatccatcctagaccagaggtgctggagcgaggcgatgtctgacagatcgatgatggtcggacctttttataggtgagattggacccttggaaaagagaaaatcagaaaggatctttttgtccctcatcatattctcgagcatcatgtctagtcctttgattttctgaattggtgagtgttatcatctcacagtacatgagggccatccccatcaataccgtgagttgacagcttagactttaaggatggcatagtaaagtggtgcggcctgatgagactacacagagagatctgatctcctgtggataagaattgacatattgaaaataattttactgaaagttcattgtcagtgcactgtcttttcagaaaagaactttcatctactcccaatcttcactaagatttgatattatgttgatgatcccagtagtaggtagattatgatggattggttgctgattgtgttgagatagagtttcttgagaaactacctctaattgctactctgtggtatattaaagtggaggtgaaactgcttctgacatacttgtaggggaagatggtgaaggcatagagttattttgtactttctgattcatcattttttcataaagtttttttgcagactacccttcctctagcaccaatctgttgttgtgagactcaaaatataagactggagcagatcagatgaagccaagcaagaaatcgatagcaatctgatttgaaatgcttcaaaaaaatctataaaataagtcaaaaatcagatggagattctccagttcttaacccttcgatgcttaagttagtcttgagcccgaaaataataggtgaaaaagaatagtagagcacaaaaagaggatttacatggaactaaagaaattggactgagtaggagctagagtccttgttcaaaaactgacaaagtttctagtgatataggcttactttagttttggaattaggattttaaactaactattgaaggatccctgattttctatttttatagaaggattgatgaggccattacagaacttgttagaccgttagaagagtttgttatgcggttatagccagctgtaagtgaactagagtataactacatgtattagctagaagtgagatcatacttaactgtacgtgtcagttagagataagttgtaacatagttgtagcaagctgaaagacagctgtaaaataattgtctgtattttggaatcacattaattcagatcggtagatagccgaactgatcataatgcttcatcaggagtcgattcagattagtttagatcgatgtttagatgagcagatttgaatcaaatcggtattcaaccgatctgatccagaagtagattttgatcaatataattctcagatgattctctctaatattgccacgtgccagagatgggtttatgatgatctcagccttccgatgagatcagctttatgatgatctcagccttctgatgagattgactttatgatgatctccacagtcgagcttcatatcgatattctcgtcaatctgagaacttctaaattatgatgacatcagctaagatagtataacccttacaacagttactatatatttaatctcgttaccctcatcctaagtaccaaattatctaatttctttggcttatccgactgcaagccattagaattggtaaaattgaagcaggattttcatttccgtatccataacatcaaagctgcctatataaaaaaatattaagggaatttttaaaaaaaatcacttgaccacgggtgccatgatctctgtctctaaacggccctggccagaacgttccaacatagttggttgcctcccaaagaaagctaaagggatttgttgcacatcatggctgacacaatttttgggctaaaaagagatattcgttgggcgttctctctctctctctcagaaaaacatcacccggcgcgtagcatttagatatcatcagttggaatgtgtctaattgagctcatctggatatggccggtacgaatttgttttcgttattttaatttgatcgggactctaattctagataaatctcaggagatggaatatattttatagtaattgcgataaaattaaattctatgtaaccatagtggagatagtccctatcttaatttctccataactaaccataatactacctctgatggatcacgctataaaaggaaattctagagacttggttcccaacttatctaagagtacttgtgaggttcttcccatcgtgaatacttaagagatattagtactctactacattcgaaatgatttagataagagcatattgtgatcacaatatatatcttaacaaaggtatgggcagcatatttaggaactaatgtctatttaaataactaattttcttacttttagaaagattgctgacccattttgggctaatatgattcaaacacgaaatgtaagttgtcgaagctattaccttctcaacttaaatgtcggaataaaaataaacaaacaagcatggaatagtcttcatgccatgtaatgtcccaaaggcaaataagcaatagagcaccaaagttaaagccaacagatctagaacaaccatcgaaaaacagcaatgggcttgacaaaagccaagcctagtttatcactttgatgagcaatacctggccacaaactccgcaatgttcctatccgagcttccaccctcctccactgactttttggccaactccccccacttccttgcattcctccggatctcctcactcctctccccctccatcaccaccctcacacacctctccacctcctccctccccaccaatcccttctcattggccctcgctcgcactccgaccctccacacatcctcaatatacttggcattcattggctgatccgtccattgcggcactccgaccatcggcacgcctaaggtgatcccctccatagttgaattccatccacaatgcgtcagaaaacagccgactgccttgtgggatagtaccgccatttgtgggatccacgaaactaccaaccctcgctccgagggcaaatctttcatgttctccggaatcttgaagctttccgaggatctcaccacccagaggaagcgtttgccactgttcagaaggccgaatgcaatctccaccatctggctagggtcgagtgcggctacagtgccgaaggacacataaacaacagagttggaaggcccggaatcgagccattgcatgcagagattgatgctggggctgtgttgtaagtcgaagccgtagtgagagtctgatggaagccggttgtccaagtatgaggatggcaccataggacctatgatcttggctcgccatatggatctcatatagtcagcttcctgcttaaatttccagcaataggaagggctaaaagttcattctaattttaaaattaaaaatataaaaaaagaattaattttgtgactaatcgagggtagagcatgagaatccaaagtgcaaaaatcctcaattgctgcaaagctgggctataatagaatagaaatccataaagtatattatttttttatctaaatattatctaaaaaatacttacttaagaaaaattgagatatccggataagttattatcctcaaaagaacggtcctaacgcacttctaatcagaatctctggaaatctaatttagttgtatacaaggctttttgctaacaacaaattgtttggctgtcacctaactagtatcattagtgtggacaaactagatatagtgtgatgtcaaatgagaaatagattatacctagtcataaagtgggtatgtttgtgagctgaatgctagaattattttttttcgtaaaaagatgaatgctagaaagtaatgtaccaaaatttattataaacaaacaacaaaacatgtctacatctttgccaaataattgcactaaattaggaaacatgctccaccatacatgttaaaattccaactacattgcatttaacaacaggatgataactcccttttccaattgttatgatcctaaccaccataagtatagacagaatctttatggtcacttatgaccgttggagatatttaggatcaatgtggatattcttatatattggactacaaattctataagaattgggcctattgacctagctagcttaaattatctaagaacacgttcaaatccaacctagaatctggatgttggactgcaagaagaaaaaaaatccatcgagatttttatttttatttttttccttctaggatttaaactagcttgtattttggttgatacaagaccacacttaaattgactgtttaatctacgaatcttatggaattttgagtccagttatatggaaatatgcaaacagcatcaagaatttgtgctgcaccagaagtaataaaatttgtacggagggaaaggaattggctctcattagatcaagcggaactcttcttcatccttgcgaggcaccggtcctctagtagtacacttaagagttccctttgccacggggtatgtgaggtttatgatgcatggaaaaggcccaaaatattttttaggttcaataaaaaatgtagttaaggatgtacctagttaactcgcactcattatccaacaaacttttactctatctctgctataacactgaatccttaacaacctaagtcataagtttttcgcactcattatccaacaaagttttactcatctctgctctaacacagaatcgttaacaacctaagttataagattttcaaatacattggctactccacatttaaaaacaaaaagtagataccattttttttccattttaatttgcagtcattttgtccacgtcatctcggatcgcatgaagatccaggacccacatgaaccgtagtccaaatcctttaataacctactcaaagaaattaaattattataatcgagaaaaatttcacgaggctatgcaattctgttttctgatccccatccagagagtagaagtttcttatagaccgacttgcagagaatccatcatgcataaattgttgttcataataatggcagctattggatctcactccgctctcatctggcacccatccacatgatgggagaataacctccgatctaatctggtacctttcatgagagattgaccccaatagctccagtgatctagactttgagcagcacaaccaatagaaattaatcaatcacgcgtcactacaatataacctggatgaaaaatttaggccagcactggatcctgtcccagtttgtttctacgtatcgggttagagtcgaacacagatacatacctcaggctgcagctcgtaggaggagttgacaaagaccacatctgccttctccaaattcttatactgctccagcagcgctttcaggcaccacgcgtacgccaaatccgcctccacaacgaaggacggcaggcagtccggctcgagccggggcaaaccgggcagcgagaccggctcggtaaccggcatccggagccggccctccttcacgagcccgtagactatgttaacgctgcagggctgcgtgaagagcgacaccgtcaccagcccgtgccgctccccgacgtcccgggcccacgggaggtgggagtcgtagaccagaacccggaccggacggcccgcggcccgctcggaccggacgaggtcgtcgagggtcgtggatccgaccgactcgaagcggtcttggtaggctgggccggagccggcctcggcgaatccaccccggtcgaagccatcggagatggaggcgagggcgaccggtccgagttcggggcgggtggtggagaggaggaagcgggtggtgacgagggtggctcggaggccgtgggaggagaggcgcttggcgaattggagcatgggattgatgtggccttgggccgggtatgggaggaagagggcgtggggttggtgggtgccgctctccatcctctcttctctaagttctcttctcttctcttctctttttaaggctaaaactctaccttaagctagggagatcgagatcgagagatttgagcggctgtgcatctccccctttaaaggggaaagttatcccctgccgttcaccccgaacggcagaggatcccgatccggaacggagagattgtgatgtgatgcgagtcagcgacagagagggtctgcgcgacctttttttttatttttctctggtaagaagagtctgcacggcttcgaggggggggggggggacgtttttacaacgacatgctacatgtactaaatctatagtacggtctgaggttcaaaataaatataaaaaatatttataaaaatttatttaaaaattaattataaaaaaataaaaaaaattatttaaaaaataataaatattaaatcccacaaatatatgcctccacatatgcaaataattttttcgtcctctttcttctcaaaatattaatttttataattctataatatttaataattttatagttccacgtattaaaatgaaatctagaattcctttcaataggtcacaatgtggacaagaatttaactcctattttacttcactatccaaaaacctattgaacacaaatactatcgatcttaaaaaaaataattaaataaatttttattaaaaataaaattttatttcaaattagatatctaaaaaaatagctctaatattttagacaaaaataactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatggtattttttattttttgatattttttagatattttttaaaaatttaatttgaaatttagttactaatttaaaatgatgatttttatttgaattaaaattaaaatttttatttttttaaaatttagaattataatttttatttttttatttttttggatctatttttttagatattttttaaaaaaattaatttaaaatggagatagtaatttgaaatgatgatttttatttgaattaaaatcaaaatttttatttttttataaatttaaaattataatttttatttttttatttttctttttttggaagtaaataattaaagtcgccatttgaaatggcattttcaaaaatgccatttcaaatgccaactttatttttttttttgtcatccacatggaggagagagggtgatgatgtggcggctataaaataccatttcaaatgatgttttataaatttatattatttttataaataagttaaaaaatatattattgtgataaataattttgttttaaaattatttagataatgaactcatttagaaatactgtcattcacttcatcgtacccgactgcaaacaattaagatttgaaaaattgatgcaacctagatttgcctttccattcccatgacatcacatgcacctgactatattaaaaaaataaaattttgaaaacatcccatcaaatatgagccatttacatttagatccttaaaatttaaaatatatcaattaaatctcaaaattttaaatttgttataaaatagcctaatggccgatctccaattgaaaacattatcatacggaggtcgtctaatagcttaatttttgaaaatttcatgtctatccttcccactaattttgcttgggacttttgtttcgatgaaatttgaaaggaaagaaaagtagtactttgagatttgtatctatagatgaatgactttattctgtacgatctatataaatggatagatgaggaaaatataatattttaaatttcatacaaattgatgaatgatagaggatagagtgctttgatatccatataagcatataaataacaaggatggagtgttttgagtactttaagatctatgtagatagatgaatgataaagaattgagtattttaagatcgtgtaggttgatagatgatagaggatggagtgatttaagatgtatgtaaatagatagatgatagagaatagaatattttgagatgggtgacaaaggatgaagtacttcaaaatctgtgtagatagatcaatgatagaagatggaacgcatcaacattcatgcaaatcgatagatgatggagaataaagtgctttgagatatctgcaaaagactggatgataaagcattgagtgatttaaaatttatacaaatggatagatgatagaggattgagtactctaagatttgtgcaaacaaataaataatcgaggatatagtactttaagatttatgtaagcatatggatggtggatgatgaagtttttttaagatatatatagataaataaattataaatgaagtattttaagatctgtatagacaaatggattacagacaaaatgcttagcgatatatgtaggtaaatgaatgacaaagaataaaagtatttaagatctgtatatgcggatggatggttgaagctagagcacttcacgatctatgctcgcaaatgaatgataaaggatgcagtattttaagatttatgtaaatggatgaatgatagaaaataattttttgaaataatttttcaatcaattaaatataataaaaattattttttttataattattttttaaataaataatttttaaaaattatcagattatcctgtaatctaatatatccaaccaaacagatcttaggagaggttttgggttaggtgggttttgatatgggtatacaagtaaagaacatacgaaggagaatggattgaatagttaaatgagtggtttggggaaggcatagttgaatattttctctcttgtccgtccctgcctcccccctcctccacattctttcttcctatactagagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttaaaaatttattttttgataaaaaaattctttctgcatactaaatgagtcctgaaagagatagctagttgtcagcttgtacggcaacaaacgagatgtggcttgatctccactcagaaataacatgagggttacgtagtatgcgctataaaatgtgcactcaaacttttttcctctaaaaaaaagtgcagatggtaaccaatttaccatcattgtccgaacccaacactcgatattctttattgaaataaattaaccagattcctattcaaatctattcaaggaataaaaataaacaaacaagcatggaacagtcctcatgccatgtcatgtcttaaaagcaaataagcgatttagcaccgaagttatggccgacatatatggaacaactaaagcagacagcaatgagtagccaatcttgaccaaaaagcaaagcccagtctatcactttgggcaatacgtggccacaaactctgcaatgttcctatccgagcttccaccctcccccactgcccttttggtcaactcccccaatttccttgcattccctctgatctcttcactcctctccccctccatcaccaccctcacacacctctccaactcctcccttcccaccaatcccttctctccagctctcgcccgtaccccgatcttccaaacatcctcgatatatttggcattcattggttgatccgtccactgaggcattccgaccattggtacacccaaactaatcccctccatagttgaattccatccacagtgcgtcaggaaacagccgaccgcattgtgggatagcaccgctatctgtgggctccatgaaactaccaaccctcgctccgaggacaaattcttcatgaagttctctgggagcttagaggtttccgaggatctcaccacccaaaggaagtatttgtcgctattgagaagaccgaatgcaagctcagccatttggtcggggccaagcataactatgctgccgaaggacacatagacaacagagttagagggttgggagttgagccactgcatgcagagagtgacgctcggggtgtacaagtcgaagccatagcgagagtcggatgggagccggttgtccaagtatgaagatggcacagtagggcctatggtcttacctcgccatatcgatgccatatagtcagcttcctgcttaaatttccgacaagaaggacggctaaaatttctttctaatttcaaaactaaaaatttaaaaaatagaattaattttgcggctatatcttaagttttaatattgtagctattgccacaccccatatgaggttggagaattcagaattatatgtagtttttatttcctctgttgaaattaattttcctcatttcaatgaatttgattttactgtttgattctagctaatccattctgccaataaaatgatgagaaatgatcttcttaagagaataatgagaaatgctcacttatctcaaaaagaactaagcataacttcaaagcttagctaccacctgcaaattactgatttgaaattgatttggcatgatagtggctctattgcgatatgttaaataggattgcataaaagcaggaactaataaaaattccacaagaataatgtacacaaaccatgatggtgagatgtaactatacagctcaataaccagagccgacattgacatcgatatcggcaaaccatttgctaattgcaatcgtggatgataggaagaattaatgaaactaaaaataagtcattcatgtagggaaaatgtatggctaaggctaccttcgacaaccatatcagtaaatacattacacataccatttgtgaccacattggtaatcaaactaagtcttttagtgggtaataaatggaattatggcaaagagagacaagtacaaaatattccaagctgtcacaagtctatagccaatgcaaaattgagcaaccacaaaaaaatagccattgcagatctaaaaatcaaaatttactaactatggaagcatgttcatttcaagagaaccaccgaaaagtccaacatcatcataaataaaggaaatagcatgaaatgggagtgcaagaatccacaattgctacaaactgagctataatagaattggctcgactctaagatacttctagtcagaacttttgggaaactaattttagttgcagatatgatttttgctggcaacaaattgtttggttgtcatctagcaagtatctttggtggagacaaactagatatagaatattgttgggtgaaggtatgactattcctagtcagaaacaacacaattcatgggatgcatgctagaatttttttttttttttctttaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagtaacaatatggtttgatgagggacaaaaatctaaccatcttcataatttaacgcagagtcggcccataatcttgcatcaagacccacgagagaacaacatttggcatcgatgattcttgttttacttagatctcaatgtgagatgtagttctagcaatgatttgataagcattgaatccaactcatttcttttttcctttttggtataaaatgggcggtcacaccaatctgatgcgagagcagaccaaacaatcaagatctacaaaatttcgcagggtctgcaggcaatcatcactaggcctctatagccagtcatcggaatggtcaacaataaaagttgccactcaatctgctgcagtgttcgcttttcggaaaacatgccggactcgcaccacaacaacttgacgaaggataatacagatctcccggatgagcggatgaacctcgaactatgtggtgcctccctgaatccaaaagataacaatagcagagtcaccctctagaaaaatttgtttcgtatgaagctgctgcctggcaaagatgacacctgcctaagctgcatgaagctccgctattggaactgaaggctcaaaaaagtgagatccaccagccaccaaaagtctaccgtttgggtcatggataacaaagcccacactatccctcccacttcggatactaccatcaaagtttaccttgacaaacctcggaggtgggggctcccaaaaaatggatagaatcctacggatcgctgttggggcagctagggagctccagagtttgggtgtgtcttgggatgggttggtaatgtcaaagtggcagtacttctgagctaaacaaactgctctctcaagaacccaacgagcaggaatcatatcactatcaaacataaggctgttttgagacacccaaacctggtaagcaatataaaccatccacccaccacccatagctgtctgatcaaccacactctaacggatcaagccaaagatagaaatcaactaagggttagtacgtacttgcctcctatgaaaaactgcccgtctgtctccaaataatctttgccctagggcatcgcaggatagtatgcttcacagactcatactccatgtcacagatcggatacactggctgaacctccatgcccctctccctgagaagtgtttgagtaaagagacagtcctaggcaaattttcagagaaaaatctgaaccctcggatgagcgacaactctccaaatttaggcagcctcaatccgtctagagagcatcgggctgtataatcgggaaaggtccctcaatggaaccctcaagcagcagaaaagtccttagaccctcacattctgtgtgaggtgtacaaaaatcaggatggcaaggatcctctccgccagtggctgcccaaagagttgagtgatcttttatactctcagctgaaagtatcaacagcaatgagatcagacatcctcatgtgatcctccacctcgatgctgacaagagttggccaatgagataaaggaatgctcaaaatccaagcatcctggatcacccccattgaacgactatcacccaccaagtatcggatctggtccatgacatcaggcccctgagcacaaatctcacgccaaatgaaagagcagccccggacaggctagatggtagtcccatggctccacctaccatagtgagctctcatcaccatgctccataagcaatctaactggatcagaaatctgactgtatgtctggtaagcagagcctccctcttcatcaataaataatggatccttagaccatcatcctgcacaggctgacacaccacctcccaagacagtagatggacccgacgacggtcacagctagatccccacaagaaattgcgaaactgctgctctagccttctgacacaagccacggggataactgtgtgggctaataaatagatcaaaatagagctcaacactgatctcaccaaagttgtcttgcctatgaaggagagggtggtggcctaccatccttaaatatgctcctgaatccactgctccagcggtctacactcagctcaccataaatgataccctgtgatcgaaaccccaatataggtcagcgacccagactactccagaatctccaggatctgcttgatcatcaatctatcatggaccttcgtcctcgggttaaagatgacagcagacttttgaatgttaaccaactgccctgacatctggcagtaggccctgacaatggatacgaagtgctccgcatttcggataaaagcatgcctaatgaggaggcagtcgtctgcaaaaagaatgtgcgaaagcggatggacatctggggtaagccagtatggctccaaggcctgaccctgaaccatagctcacaacaccctgaataatacatcagcaaacaaaatgaacaggtaggaagagagaggacaaccttggtggaggcccatagaagagacaaaaaactctgtcggggtgccgttgacgagaatggcgaagctcgggtactcgatgcagtccaggactcaatgaatccacccctcatcgaagttgagcttttgaagtgtctgtcgaagaaaagcccaactaatttgatcatatgtccactctatgtccaacttgatggccatgagactatgatgacatggagctcattggaggtcgtgtatgaactcctgggccaacaaaatattattggtgatagaccgtcctacaacaaaagcaccctgctctggactgatcaagcgaggcatcagtggcttcagccgcttaaccaaaatctttgcacacactttgtagagggtcatgcagaggctaatagatctgaaatgctcagaaagcatagcatccagtcgcttcggaatgagagtgatagggatttgctttcaagcctttggaatgcccctaaagtcaaaggccacctgcaccacatccactacctcctcccgaatgatcgaccactaccgacaaaagaagagaggaggataaccatcaagcctccaaggtcttgtcctctccaagatatcagagggcctcacgcacctcgttattcaaaatcctattctcctacgcagtaatacagaccactggctgagcacccagaatggaacagtcctcacccagcgacctcgtccaccggtctctgaagaaatgaaagatctcctctcggatccctccactatcagccacaacaccaccatcactcctctgcagctgcttgatgtgattggtggactttcgaatcatgatggactgatagaaaaatctgaagtttcgatctcccttccgcatctactgaaccctggacctttgcctctagtaaatctcttgctgcctcaggagagagtaatgctcagagagcttacctcgtagctcccccaactcatgctcaggtaagccacctccccggtcctcctaaagctacagctcctcaatatcagcctcaacccactcaatctatcgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgattttcctttacctatttatataagtttttatagtcttcctgaggccataaaattactttgttaaattttgtgcaacagcataaaccagtcaaaattttacattagatctaaaatcaacctaaggttaagttctgagaaaaaaatttgttgatatatcaaatactagaagctaaagagaaaagaaagagttcatcatgattttgagtttttttttttttaaagaaaaagaaagatgcccacccatctacttcattgagacaatgtaaggggatacagctctctcctcagaggaggagagggatatagaaaagatacaaaacggaaaggaaaatgaataagagggaggtggtgaatcattaaatttttatcaaaaatttggcagaaaatgtagtcgaaatctttcattgtgtatacatctgtatagtccatcttcctctgtattttttgggcaaagtggtacatggaaaactctgattatttcttagcaaataaaaattctacatcgagtaactctttgactttatctcttaaattagatcaagtgattcaaataatagtgaagccatgtatatttaccatcttttactgatgaaacatgcatacttacaggctattttagcaaggagagccttctgagcatgtgtctatatggtttactgcattcagattatatctcttcataaagtttctacaatgcaaaacttgttttcaggtgatcaattggatggcaaattacatgccaatgaaagcgattggaccaatggtcccatctacatgcataaatgaacacttggatggagacaaaaattatggtgtagacctatggaaagcaaacggtggagtctgtatgaactggcttgataaaagagaacctcagtcggttgtgtacgtatcctttggaagcatttcaaaagtagggtcagagcaaatggaggaattggcatgggggttgagcaagagcagctactactttttgttggtagtgcgaacagtggaggaggataaacttccaaccaaatttatggaagagacaaaggagaaaggattggtagtgccatggtgcccacaaccagaggtattagcccataaggcaattggatgttttgtgacgcattgtgggtggaattcaaccttggaagcaataagcctcagcgtgcccatggtggcggtgccgcaatggaccgaccaaccgacgaatgccaaatgtgtggaggatatttggagagtgggagtgcgagcaagagtagatgagagtgggattgtgagaagggatgagatagaaggatgcataaagatggtgatggaaggggaaaaggcaatagaaatcaatgggaatgcaaggaagtggagggagctggctgtgaaggcattgatggaagatggaccttctaacaagaacatcaatgattttgtagctagagtagcaactaaaaaggacctgaagaccataactttagcttcatgaaaattttcagattgaatgataagtaacaacacctatcatttccatgtaacatgaagtttatgatgacttgttggaagctgcttgtcatcagaaaagggcatttctgcaagctccatattttgccaataggtattcctttaaattcttaacattgcgtagttttctaacagtcagcaggatgagtcatcttgagagtgtttagatgagatgcctcattggagataaaatgtttccaatcattcagaattaatgtgtaaaggaaagctgaggggtttcaggttctgcatgatcggtgcttagtgtgatgcgaacaccttcaatattagcattttttttgttttaatttttgtgcaccaattattaccgtattatcacctctggaagaaatctatccggctatcagaacaataatctaaggcagagagatggttaccaaccagctgagctaccaccttttggccataatgaatgactttcttatttcaacgagaataagaagaagaagaagaagaatataatgaatgtctttcagcaccttggtggaatctgaaccatcagatattaactgcttgggtgggatgatcaagctcagcctctgattcacataccattaacctgatgttctcctgttttagaataaacaatctgtgcttgttcgtcttttttgatgattaaaaagaagaaaggacaaggataagcacagattgtttcttgtagaactggagaacctcagcttgttcttgtcttgttcttgttgaatcctcatcttgttcaacggagcaccctacgtttggtcgaaaaatggacactcaatggtgctaattctgctatactatgttccgggtctggcattatgatatttcccttgctgtaaccctttttttttgcttttgaaaagtgaaaggagtgaggcactcctcccatggatttgaataaggtatgagcgaagtaccagaccttccctgaccaaaaagatgtaaagcaatagctatgtgttcttgaaaaggacacagtgcattgtcttttggtttacaggggaaagcacaacttcatcagagaaaggctctctcttgctgtaacttggattgcaccataaaccccttcacatctctggagccttggcaatgagcctatgaatgcaatactacactacgatgaaaatggtcattaacgacgctattaaggttattttacgacgctaataaacgtcgtcaatattctttacgatgcttcaaaaagcgtcgcctatgtaagagtggagacggaaagcaccgacgctttttaaaagcgtcgttattttggtaacgacgctttaaagcatcgtaaaattaacttttaacggcgctttttagcgtcgttaatgacaacgcatccgccactctaccaagacgctttttgaagcgtcggctgttaggttttttgcgacgcttataagcgtcgttaagtttgttttaacgacgcttttaagcgtcgttaaatgcatttctaacgacgctttaaagcatcgttaaaaccatatttaatggtactttttagcgtcgttaatgactctgcgacccgcactctaccaagacgcttttcaaagcgtcgacttttttgtctttaacgacgcttataagcgtcgttaaaggttttaagagaaaaaaaaaatataggttttatattccaaaaaaaaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtcgatattttctttatttaacgacgcttttgctaaaagcgtcggcgttgacagtttcaaatattacgatgcttttaagcgtcgttaacaaacgacgctttttaaaagcgtcggcaggtcagcaacctgccgacgctttccaaaagcgtcggcaaaaaaaaggccgataatttaatatttttttatagtgctagtacatttcctaggctttgaaaatgtggagaacccacttcacattgttcagcgagttggacacaactcacctatcgaagtgacatcatcctgaatcattcttcctaatgaataattaggtaagatctttgggtcccattaaaagaatcactgactgtataaaagccataaaataagcatggcgaaatcctcttctcaagacactacacttgttaaccaaggcaaagttttggtctaccatgtaatgtgtctttgttgtactcaaccaaggcatctaagttttctaggtggagtcaggttgctgcatttgcttatgcggccagacatgatggcgtttggcaccataattccgttcagacgtttggcttttctcaatagctttggtagccaacagccatgcacagaaagttgctatctgtactgccaagtccccaaaccatgaagtcataattcaggaaacattttttcttggaggagcagtattgttggtgtgactcaaaaatctcactagttccaccttcccatctttcgatcgctttataaaccccctaagaaaaacgcatcagtttagcaacatcttcaagtatttgagctacctacaatcaaattgactatttaatttcatcactccaccaacattgaccaaggtataaaggtttctgatgcatgtgtcaaatattttagtgctggattactattttgtccatttgggaagttgttcattctagatgctctctctctctctctctctcttccctaaggagctacgcagcttatttaccatgactttaatatgtcccatagaaatttgaaggttaaatgtgccttggagtcaaggtagaggacattctgagcatgatcagcctccccattagccacatacctaccaagtttagttcccctctatttaggattaaactggagaggtccatttcccaatccccagcttctatgcagtgaggaacaactagtgattgagtggtaacttggtagccctgttcaatcactagtcattctgcaagacacagagggctagtgattatgtatcagatctctctagttcaatgtgaaacttgatagatttccaactctcatctatcaaaagtggtcgtcaatttccagatgacctcaatgatttctgggagcatccagtgtttctcttatcatattgagtgaagtggatcttctaagcttaaaaaatgaccttagagtcttactttctcaataattgctctttagatgatacctccatgccatgtccctgtttgcaagtaattggcatggcgtacaatgcagagaccttagcatacaccaacctgatatttgtactggattgatgccacactatcttttctgtattagaattggtttattctaagcaaattttcatcgttaaatttcattgatttatattcttaatttcttaaaaaatatattgctattgagttttattggagaaactcttaaaaaaactgcatattctggaaaaaagagaatgcactggaaggcaaaatgtagacttgtaaagtatcaagcttagatgataacaagtgtcaccatataaatgtttttgagggaaaaacatcagtataatacagcactgattttgctaaattatgatcacaactaactatatatatatacacatcctctttttataatagttgcactcatttaatgcctctccctccttgtgtcccaccatggcatacaaatcactaatttatatccaaatctaattccaaagtttaatttcttacaaaatctcaaaaattagctaaatactttccgttaaaaaaatgctgatttgttatcaaaaaaacccttcttgcctagatgagcaactcaccttgagggcatgcctctttatcacatgatttccaaactcatagatgcaatgctctaaaccaagaggtctgtcgacttgatttccatatctcattttagtaaacaaaacaaatccatattaaaaaaaaaaaaagcccagcattagcatactatatattaggtatttagcagttaaccaccattctaattataagaagttagcttaagcgagcagcaggaatgctagagagcaataatttacacaacaatattggacgcacaaaatttagggatcgactgacatcataatcacaattcacaatgttcggtggcccccactaaacttcccttcaaaactggacaaggaactttcactagcgtggggcttggtttcattgggggcccacacgtatggtgggatgcggtgggcacagcttgtgtcattctctcgcaggcagatcccggacccggttccttccgtcccacgaccgatcgcccgtgccgtggctttatctccttacgtgtcgctctccgattccttcgtctgctcttcagtacacgtgaaggtcggccgtttcccacccggccgcccgcttgtcttctactgccattttctccaccgcttactttatggcaaaaaaccgaagcctgagctcccctgctctcttcgtctctctctggttcttgttttttttcctcctcttctttttttcttgcttctccctttcgcgtcaatagaatcttctaccgcaacgagttctggcaaggaaaatattctcgcatatgatcgaggtaagtcggttttgatgggaaggatcgaggttttgatacgattttagaggtttttgttagaggtgttgacttttttgctggttctgaactggaagaagcttattgttgcaggatttgagtgatcatggagacaaaagttgcttttatttttgacgtatagattgctatttgttgcatatcttgttcaattttgctattcgagagagatctgagatgatatggtcttgtatatgatcttccgatcattgaggtcttgtgattttgatagatgtggatagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctagactcaactagaggcagctagtacccaatttctagtgacttaccaactcagttgtttggcatgttcaaagctcagaaacttcttacctgggattctttcgctgaatatttatcaagccatcacccattcaaggcatggacaacggactcatttatttgttatggttgtgcaatttgttatggtgataaaaacatgatctaattgaattggcattagacactaggactcaattgggtgatttgttgggtaagagtttataaaaagttatatagttgaagatgtattgatctttctttcagtttccaatgcagctatgaaccggatgcagtgaagaaatttgttcttcacttgcttgtcatgtcacacacattttcagtcccttcactgaaaagggcttgcatcaaagaactggaaacaacattgctgaccttggagaatgtggttgatgtgcttcagttagccagacagtgtgattcaccgcgcctttcccttttatgtactcatttgatcattaaagagttcaagaccatctcagtgtcagacgggtggaaagtaatgaagcaagccaacccctgtctcgagcaggagcttctcgagactctggtggaggcagattctgtaagttcagttcttctcgggttacaacttgcaaggttctattacaactatttatctaatgtttgcttacttttcagacatgttatgtgaaatttgcagtagcactgagttttattttctattgcaaaccataattatttttcctattgcatgtatcactagaaacacccttttgttgatttggtatgtaccacaatgcagaactacagtagcccaatccttgtaaatttgctgcagagagcagtttgaaactcaggattttctacataactgaacagtgtgggtaatgtaacatgcttgttcaatacatgcgtccatacttattaccattgtgtcttttctgattaactaacttttaccttttttttcatcttgttttttttccttcctttttttcttttttcttttgaaaaaaagcagcctacaattcaaaccctcaagagtacctaaattggctgtgtgttcaagatgctttatgatctacaaatattaatctgctaacatatttgtgttccttctttttttgctcccaaaattttggaactaattatattctgtgagagggaatgagtgataggtacaatcctaaatttgcatatctgcatctatggacacatgttaagaggcaataacttacatcatctatcccttattcctcgttctaatttttattgttgtacatgtagtcattggacctgatcgacatcagtcttggcactgatgcagaaaaagcaggaaagggcaaaaaagatggaagaaagaaaggtgtacatgcagctgtttgaagcaatggaagctcttttgcacatctgcagagatgggtgtcggtccattggtccttgtgacaagatgctcaaagacaaccaagctgcttgcaacttctcagcttgcaagggactggagttactggtccgccatttctcagtttgcaagactcgtgtcccaggtggttgtgcacattgcaaacggatgtggcagcttcttgagcttcattcctgcatgtgttctgaaacacactcttgcaaggtccccttgtgcaggtttgtcattcattagcttgctttgataacaaattggcatcaactagatgctctttgctgcaagtttaatgctttcttcctgtgattttgaagactttcaccttccactgttgcaggcatttcaaggataagatgcagcacataagcaagaaggaagaactgaaatggaacctgttggtcagcaaagtgatggcagcgaaaggaactattagctccatctctgcccggagaaacttggtaatataaaactccattgtgagcaacagaggggatcagaagtgtatcttaacgaataagtgctatgagtaccgtccatgtatctatgttaaaataagcattgcctgtactcatctaggttgccaaagcttgttgcaccgtgacggtgccaccgtatgtaaagaaattatatcacgacctatgcagaacttgagagtaaatttcagtgctaaattatcatatgtcattctatccatcttttccctggggtggtcatgcatggatcttgtattctggtgactgtaacaatatggtggaattgaacaaaattttgtatcactgtacattttgtgccttctcctataaataatatgaactcatgttctttggatgtgtcatggtcttattaattctattggtgaagagaattgggcatctcttaatttgatggtggttgcatgaattttgtagcttgaggattgagttgggagagaacagattagggttatcacgaccatggttatgaatcgcttttgtgctggcttcaaatcaatgattgtttggcttgaacctataggttgtttcatccatgctcatcaaagtctttctcgattgagaatgttccattttcctagacaggtaaccccagagaatatcaattggtgagcaaaaatgaggtaacaacatcctgctactctgcattttgagtttctacaattggctcaaatttactgtctggtttcatatttttagatatttagcattcagtctaaagaaacacaaacattccggctggtgtttgtaggatgatagatcaacaaaagcatgtgtggaagtcatgggagtggcaagaacggccagtagaggagtgtaagaaggcagcgagggatcttaagcggaccccttttgaatgcaagcatgtgagccttcctctgaactcctaggcttggttctttgaacaagcgtccttcgatgggataactgcaggtgaggcccaaacaactagacgggttggtgccatggcaaatgatgaaggttgggtagaggatttattttggtccaattcgtatggatcgaaaatataaatcggggggaagcactagtgcacaatcaatttgggtcaaattaagttgaccatctttttttttttttttaaatcctacaatcaaaagtagatcagaagacccgacttgcagctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactagccatccaaaaaaaaaaactcaaaagtattctgtatttatgtgggtctggattcaaccccgtcttagccgtctatgattttgtatgggtacgtgaattaaggcttattgacttgttgtccaaaccaatccgccggaattaccggctatgcatggggagatcaaaaagtatcgggaatccattcttaacacctaaaaaaatttaaaacaatggtgtcgagcttgcgtgggaaaaataccagaaaaggaaacccaccaccattcccgtcattagtagtagttgccattgcccgcgattacactgacactttgactcttcttgttctttctctcttttttttttattttggctcccatcctctcgttttcagagcagaaaatacgagtcttaaatcactccctgacgcactgttctaatctcatttatcatcaggaaaagacaaacaaaaaggaaaattaggcaacaacaaagaaggggaacggagccaggtaagacaccatcaataagtaacttgaagccaggtaggacaccatcaataatcagcttgaagccaggtgagacaccatctataggttctagttacttaaagaagtatagatcatatgtcaccaaaaaagaaaaaaaagtatagatcatatttaatttgaatatcttaattattaattttgaacttggtgtcatcattttgtctttcttcctttcatctgatggttcccagctatgccatccagagactcactccctgttcgtactccatttaactcacccggcgttccagtttgtcacccagttgccattttactcaagtacgagggtattcttggaaccaaacgaaatccttcacacgtttacctatcgtggcatcgtcatattgtatccaaacgttatcctaaggttttattttctaaattgacaaaactatccccactaccgaacaaaatctaacacagcacgagagattttaccatcccacatcgcggtatcgcggagccccaaaattggacggtggccattagatctccacggcatgagagcaacgtgatgagaaacgaacggttggatgtgggtgagacagaatggagggccgacctgaaagtcgaaaatatgtacttcttttttcccctcaaaaaaaaatctcgccttttttcttttttctaattctctttgttcctctttctcccccactcccgtcttcccctcgagttcaattcttccgacctcgagctgtacggatctctcgtttcatcattcgaattccaccattttagggtgtataggcggttctaaatcgagattagggtttcgggcgtctggaattttggtgggttctccggccgccgccgccgcctctcgatgggatctggttttctggagctggcgcttgattctgtcagtggagttgttgaaaggcggcatttttggtagcctgggcgctgagtgagttgggcttggaaagtttggatcttgggtcttgtttcagtgggaaatttggaagttagggttttggggtggttgatttggggcaagttttggtggaggaggggtgtcaggggtttggatgggcttctagggttttcggtggtgctgagaaaggagtaagatgttctactcgcagtttattttggccaagaaagggccacttggaacgatatggatcgcagctcacctggagcggaagctgagaaagaatcaggtcgcggatactgatattggtgtctcagtaggttggtatcctgtaattcatcagctattctaaccttctccttcttcgccttcttgtttgttgtgttcgtcgttttcttgccctgttacagtttattcgcagagtaacccccattgtcatatatcccacatgagcttagtatgctaaagctttgattaaatgcatttctttttagcatctgctttcaaaatgccagtcttttggaattgtaaatttgatgtacctgcggcttagatgtgtcaaacttttaatttgatcactgtgctcaggtgtgtcaaattttcaatttgatcacagcagcatttttggtttttggctataatacgatttgaccatgctttccccatagagtttggttctagtgattcaatgaatttaactattggtgtaaaattttctccatatttaatattatgtaaattttttcttttccatctatccatcataggactatagctgagcgaaagtttttacaattgcatctgttgctatccatgtctgatttatgaagctctaccacttgtacttaatgttctgtacacagggcttcctccaatcctctttacctttccttctgagcctctcactccgaggttcgctgaactggtactggatagcataccagctagcgattggtttagcatggcatggttttgtaccatgctgttctggggtgtagcaacaaaggaagagctggaagaggggggggggtgtgtgcgcgcttggaagccctaatcaaaacaggatcctctatttcattttgattagggcttttgagcctggagagctctctctcaacttccctcccctcctcttcctcccccgctcgctccctcacatcctccctctccctccgattgaggccatgaactaataactgaccagtctggtttggtccgattcaaaccaaggccatgaactaataactgaccagtctggtttggtacacctcaaaccaaccggttcggcacagttcagtgaacgttatttcactccctttctcctcttcacacaatgattgattgcgaccctcttccttaaagtaatcatattaaaattttctgcacactatcagaaggttctccatcaatttatctccgattggatttcctattagttccttgttctctctaattttgtttgtcctagttttaggatctttttgtttattttgattggtgaggatggggcatgatggggtcttttttttttttttggtgggagagggggggggggtaggttattgtactgagctgagtaaataggaggagtctttaggtgaatgactggagttagggtttattgtatatattaatatctttcaatcaattgacttcaaattgcttcaaacatctaataagcattatcacactgatgttatttgaatttggaaaggttaatttgttttacatattcataatttgagactgcttatttattggttcacccaaaagtatgattatgtgactaagaactgattgttcattttgttttaaagaaggctttgcatatgtaaagtatattaatattgtgttgtatgataaatatcttactgtatgttaacctttatcaaagcaaactcctaaggggataaaagacataataccaaaatgtctcgaaaatgagacatagatactgtttgacttgataaacctgaactggattaatccaaacctttgtatttcacattgtttattaaaatctttatgagtcttgccttgtctcttagtttgaggtgaggctgttcaaacatgcctaggggctttggggtgatgctatgtacattgagacttgaacatcacatggagaagcccatgtgagatgatgacttgcacattaattgatttctttcatgtacatattattatttattatttccatttcttgtggaatgagatagagatccttttttaattttttaattgatattctttgtggcataaacatttaaaccatggttgtgagatatgatgtgtggtggatcatgcattctaagctttacatgaaaatcttggcaattttgaactaaagtaggccaatttttttttttttttgtatgttatcttcaagattttaacaattagagtaatgtgcaaaaagtcatgtagtgggccagtgcaagcatgatatcatgttccaagtgttactttatcacatgatcttcttatttttcaaacattccttttaatatataaagcaaaccttgagagtttttgtcttatgctttgagatggacatcaaatcttctggagcctatatgcatcatctgaggtttccacctgttacatatttcatttaagtgattagaaaggaacttttttcccaaaatcagaactattagtcatcaatttaaggagaaaattgcctaagctcaatatgatgtaggatagactacaatattgagaccgaataaagattcgatccacaaaagtagttttttgtctgttgtgagttgtgattgtaaattaccgtcttccttttttcgaagtaataaaaagcattcaaaaagtgaaaaaagtttagcacatttatgaatcaataccgagattatagtaatattgaagtggtcaaagtccttaaattagtaagtttgaattgaacacttcaaatttgttcaaaatttttgaattttttttttctgtttgagctaatgaatgatcaatagttacggtaaactatcaattaatttatagatttataaatatgttaatgatgccacacaatgatctgatggtggttggtaaaaacaataaataatgttttctaaaataagagtctgcttcaattaaatttgaaaggttgctgttttattgtgcttctgctatgtgcattggatgtcatataggaattgtggccacagatggctgtaagttgcttacatttcagtagcataggtgcggagtagaagttctgatttgcaaagcatgatagcctaattctgattatcggaacccaaccggtaggccttgtgccaagtgtcgatatggtatatcttttggaaattggttccctgttggtacggcatgtcccatattagatagtatggtctggtacctaaagcatttgcttctgcatgtttcatgattatgcccatgaatgcatcattctatcatttaagcacacatgtttttgttaaatttttgaaaaataaaaatataaagtaataaaactttgttttatttgtttagccttgatattagtgtatgccattgctagagatatgttcttgtcacaagttttgatattgtttcatttagtaaggtttttgatcatttctatcagcaaatatgctttatgctatggtacctagactctctatttttaagctatgtaggagtgtcaacgcttttaaatacttggacatggcataacatgatgtggctagatacttcactttgaagtgtcctgttaatatcatccaaaaatgttggacatttaacatatcttttttcccagtggaatgtaggggaactcttagttttaagtgctggataccttcaatttgaatataaagttttcaaggttttgtaggcactccaagcaaagtgtctttatgctattatataaagttttcaaaattttatggacactttaaacaaagtattattatattttttatataaagttataagaattaaaattatagtttaaaatgccatggttaattattgtgttaaagtatctcaacacatcttaagtgactttaaaggtacctagtgaataaatatacaacttgcaaaatcatggatattcatttatttgcttgttagatagcatctacaactctccttcccctttctctgtttctttttttttttttggtgaataagcatcaaatgatacaaacacatgtttgtacgacacacacacacacacacacacacacacacgtatataacatagtatataacatatatatatatatgtctatacacgtgtatatatgcatacataaatgcatgaatatgcatatgatttatatgtgtacatctgttctgtccccatgcctagattttttaaggctaccatgtctagcattggaagacacaaataggtgtctaggtcaaggtccatattggttggtgctgtactggttgatatcttaccatgctgacacttagtacgccgagccttaccgtaccatatggtgtaccgacatcgtaacaggatggtactgagacagtgaaccttggtgtaggtaacattgccttgtgtctttttttttcttatggatacaaacatatagatgcagctttacattgatcacatgaatctttgacgatattacacatcctaaaaaggcaattttctcactaggaggatttcacagatgtgctaatataattccatacatttgtgatattgttatgttattctaaacgtgaaaaactatcctgcaagcacaaactgaataaccaaagacaaataactcgttgttgcccatcatgccctaaattagaagccatgctaaagaacctgggaactacgagaacatgattggggtgttctagatgctaaaaagcagggaaaattaagactaagaagagggacgtatcctatgttaataggcatccaattgtttaggaactttctttgtgctcctaggatggtgagccacttctttatggtgtatctgaagctagtgaactggtctgtacatctgtgggcttgcttgagtttatgcttgagttatggatgtgagaagactaatgtgatcttttttagtgcaacatcagccctaactctctgtttggtataaagaatggattgaatgaaggatggatggaggaggaaggatggatggattttctatagatcctctcatatatttggtgagatatagaaggatggacggaaatgatttcctcctttgtttggtataggaaaaatgaggagaagaatagatgatatttttataatatttttactaaactattctttgataaaaatattattattatccatttataatacttatttatactaaaaaagtaaacaacgtataaacttataatctttataatctataattatataaaaaaattatataaatattaatttaatacatgattttatagattaattattaatgaattaattatataaataaataattaatttataatttagttaattaatattatacaaatagttaatgaaaatagtaaatataaatacagaaatagaagataatctaattatttaattataattatgaaaagtatatactaaaattaaaataatgactcataaaatttaatagtataaataaaaatatatataaataatatgaataaaaaagtgaagaagtattatagttttatcaaaaaaattaatgaggggtgattttgtcaatgcaaaagtccatccttcaatgcttcatccatccttcatccttccaatttgggaggatgcaaattggtggaccagggtggatgggcaatgccttctttttcatccattcgtcctattatttattgaaccaaatggtggatggaggtcatctatccttccaatttcatccataaattttctaatgactccaacaaaacataaggtaattttcaccgtaagaaacgaagatcaggtaaggaggagacaatagattatgttaaactgggagagctacattgttgatttaaactaaagctaaagataatatttttaaaggggaactaatgcatgggtacacttgatggtgatgcccatcactttttaaagtaattagtgacttctccaaaatagaagcccattaactaaaacaactaattaaatacttcgatggttgtcttttggattcatttaacaatgggagtggcataggggaatcttaaagtgacctgatactagggattcaagagatatttcaaaaaaggaaactctttaccattggcatatatgttaatttaacaacatataatctcccttttgtgcatcgcacatgagggggcttttgctcttatctattatttcaattctttgctttattactactggtttttattctcaaatatattttctattttttctctttcttttggggagggctgaaaatgggttggatattatatgatcaaatctgtttctgtatctagttcggatcagatttgaatagagatccttatatccgatagaatgctaatatggatccggatatatacttacaattttgctggatatccgatatggatatggatattaagttatttttcagatttggatttgaatatagatattaaggtttttttggatccagatgcagatagggattttaaggtttgtgatagcattgacttttaatatatagttatggtttattaaatttattcaaaacttagtcacattataaaacatggtcctttcaaatatatgtgatattcatattttaataattatttttataaaaaaatcaatgctttttttttgatagggtgaaagactcatagaacacgggtatgaatacaatccaaaatgttagaaaaaaatgtcccttggaatgaaggcaaaacagaagcatcagtccagatggtccctcctgagtgctgggcaacatggctagctacctagttggtagcactgttcgcctctcggtatatttgtttaatgtcgacagtgttgcatcctcttaggagcctccaactgtcatggatgagagggtgttgagccgctccactagtttggctccacatccagcctaccactgtggtagaattctcctcaatcatcaatcaattggcccttaggaccccttgcatgcgtgatgccccccaggcctcccgcagctctgctctaggcacggtggtctcaaaaagatgggtcccactagccacaatcaatctagaatctggatctcggatcatgaacctggctctgccattgcttccaataacactaccgtcgaagttgacctttagaaatctgggggatgggggctcccaagtgagaaaactcatcgagacactacatgagcgtgaggggggtcctagatgtcccaagttataaagatcgaatcagtggatgataggtcaatgatctctactgtttggatcatggccatctccaatacaaatcttgctggctgccatcttgcctaaaaaatgtcgttgttccgagttagccagatatggtagacaatgtaagcaatcttgatactggctgacccagaatccttggccatcgtacactattgtaatacctctatgaaatcctgtattgtccctattgactggagcaccctaggaagaatagtggacagccgctagatgtgcgtagctctcaaacaagaaaataatgtatgttctatcgtctcatcctccagaccacaactaggttaggatgtcgggatgtccatccccaagccctcagcaacaccctcgtaggacgatggctccgggcaaccttctagagaagcagacgcacactagggtgaatctcgagcctccagatccaagcaccatccaatctcttggttagctcgcacttgtataagtcatacaactctctagctgctacccttggtatgcatgaagaccaccatatcttggtgccagggccactgtggacagggatcgcttgggatagaactcgctcagccaactggcctccaaagtaatgatcaccaatgccacatcccatcctctctcctccacttggtgatggtcccgaacttgcattgtctcatcaacctcaatactaacaaaggtcagacaccagcacagcggaaggtcaactactcacgagtctcgggtgatgttgatcgagagcccatcccccacccaccaagaagtcagggccaacacctcaagggcacaggagtagatcgcttttcacatgaaggaacaccgccggttggccttaatatcctctacagtagtttaggattcatatttggcacgcatcatcgtactccaggggttgctaagttggagcaagaatctcataacatgccaagcgatcagagccttgtgctgaaccactaggatctttatgcctagctctcccttattgatcggctgacaaataaccttccatgctagaagatgtaccccatttcctccatggtgcgaaccacataggaagttcttgaagagttgctccagcttctagagagaggttctcgatacgacaattttggatagcagatagatggagatagagctgaggaccgacttgatcagagtcaccctagccatcattgacaaggctttggcctaccaaccatcagctctttcttttgatcaaaattagaaaaataactttatttattctttataatattttaaaaatctttttatttaaaatattcaaaaataccaataatgtcaatatattcctaatttgtatatattttgtaacatttatttaaaaatagatgattcatgattctttttatttatgctgcaattaaaaagtaataattgtatttaatatagaaaacttttaatactgttattatatatttcatttaaatcgttttacttttttatatattttaatataaatcatgtgggattggtgatttgaacccttggtcaaatcagtctctttgcaagtttaatgattacatcttagaccattgcctagttacaatgcattgcttgtaattttgatatggatttcgtatccattctttataattgtgtgatctatttagtttccattattgaattccactcgacattcaatttatatccaaataatatctaatttatatccatattcagatagagaaaatatggatataactaataccggacttgaatccatatttgtattcattaaaaaatagggatacaaatgtggatatcctagtattcgatccaaatccaatccgttttcagcctactttggaattctgttcagtctcatgttcaacaaagcaacttggtggaacaaccaacgaatatgttgacggtgacccagaatcctctttataatataatagatggcctgttttatttgatctcattatgttttccctaagtatgttctcttctcagctttgacttttatatagatgaatcacgtgcactagctgtaattgatgggccacttctcaatggtaaatatcagaacctcgattctgtttatggatcagagacatggtcatgatggataatactgattttacgcagcagaaacaaattcatgtagtggtgatctgatctccatcatgatcctatgagtaacataattcgctatatacttagtctctttgaaatttgtaaaactactgactatgactccccctaatgtgttcataaccttgtaaaagcaacttgccaagtaggaagcaagtgggccattgaactagaggatctaaaaaactagttcatactgcatttatagcttggactgaacatcatggaaccaaggttttaaatctcttaggacgagactgttccgattttttcatggaatgggatgcgccgccgtcccgtcccgtcctgatacttggaatagaggatgtcccaagatatcccaatcgggacattgggatgctagtgggacactgtatcccaacacatgggatggtatcttgtctcgatgtcctatgggacatcccgttgggacctaaatctttgcatgaaatcttgttcctacttggtttccactaatatataatttgtttcaattccatgctcttaactaatattctaaatttggcaattttgctagtaaaaggtcataatatttttttcagagacatgtaaaataaaaattttcttttgtccacattcaaatgcattgactggtgggaaactatatatgagatttggaacaggtttcaggggactctaaccttttggatcatctactttgcctcatcaatagatgatgcacctctttgacacttcatcttgaaaagatctcaactactatgaggaatgaccaacagactgattatgaggatttgatgttcatgcacctttgttttaaagttctctatccactatgttgatagagtggtgatcaagcaactagaaaatagagctgatttgacaacattgtttgttgttgactttgcatggttccaacatttttggaggttaccagcaaggttttaaatcccatgggacggtgttcctgtttctccatagggctagaattgggttcgggctggctcgaggcccattgggctgggccaactttaggtcgggcttcaagctaggcccgcaacaattttggctgggttcgggcctaaacatagggtccgtttgtctttcgggccggctcaagcatatctttggtccagcccgggctcggcttggctcgagcccaagctcgaattccagcccaatttggaggatactcgtgccgtgcttgggagaagcccttgtgctctatccaaaacccttcaatcttggatctatggagtctcttcattccccgacggcgtgctaaccctttccttcccctcccaccgccacctcgtcatgcttccatcgttgccattcctctccctctcttccggccccgcgcatgccaaagcatgtgccgggaggaccagaaccagcatctttcttccctatctcgttgccgccatggtgtgtcctttctttcctttcggcgccttggattcgatgaaaaatagaaagaaatcgatgtaggaatgactaaaattcaaattttttttgttgtttttgatattaaattgtgaaatccactcgaaaagcagtacatgttttgctttttctcacagccaaggaccgtcgaaccagaatcagagctcgtgctggccggtcggcgatacgattcagtatgggtctgtactattctgtgcggggccgaactgatagggtagagaaggggagaaggagaagaaagagaggaagagaggggggagagccagagagggcctccggcaggtgctctcaagtcccttggcgtgggctcgtcggtcgttggagacatcatggtggcagtgccatccatccggaggccttcgacggtctccagacatccagtaagactcttcccctctctctccttcccttcctccacccttaccaagctcgacaagagctcggatggcctttggcagccctctcttcctctcactctcctctcccctcctctctctcgtcctctattttcttcttcctctctttgagacagtcgctgtgttgttttgtatgctggaattggactagtttttcgttggtatggttgaagatgtttcggagaacggtgttcatagctttgaagttttcttcgagcccgagttcgaattctagcccattaggaggatactcatgtcgtgcttaagagaagcccctgtgctctatccaaagtccttcaatctcggagccatggagtcttttcgttccctataggcgtgcaaaccctcttcttcccctcccatcgccacctcgccatgctcctgccgtcgttgttctgctccctctcttctagcctcgctcgtgccaaagcacgcaccgggaggaccagaaccggcatctttcttccccaccttgttgccgccatggtgtgcccttcctttcctttccacaccttgtattcggtgaaaaatggaaagaaatagaggcagagggagggggttcaggccgggtctcgggccttaaattttaaaatattttcgaacctaagctcgccttgacgtctgaaaaaatatttcggaccgggcttgggtgggggtgtggtcctatccaatccgacctatttccagccctatttctccctggaataggatgccccactgtcccatctcatcccaatagcaatctcaatcatgcattctggttgatatcttctatcttccccccttccctttttttctttcttttttctttcttttcttctatcttcctttctttttcttctcccttactttctcttttccatttttcatcttctatcatttcattgtttcctttttttcatctttccttcatttccttttatcttttttcttttttctctcttgatggatggattttggagttccgaacccgtcctgatctcgttttctcacaggaacaagacaggacagctgggacgcccctcgtcctgctgggacgtcccctgtcctgttgggatgtaaaatgttgattactagtaaacaaccgctctttattttggattttcaatgtgttattgcctcttaatacaatttggctcactaacgtgcatcacatgctatatgtgcagtattacccccatttgttgttgaaaataaactaatctgagaggattagtagaaaagatatcatctgtatgttgtagtggatggtaatgaagcatgatcaatcacttttaagataaacttcaagaggctcgttcaactaaagtaatttttgatagctgtgtaatctaatgtttggtgtttctctatatggtcaaccactgtccaacactttgaaagggaagtccttaagaagtcactgaattgaattatgaattctttatatggaaccttgatattgtctgcctttccgtcatctttctgaccatcaaatatcttgtatttactagaaaattctgatgtcgttgtcacattgacccttagtcaactttaacaattttcatataaagattgtattgacaagggtaacaatcaatatctagtttgtcttctattggtgaccagtaaaatttcttctaccaagctacactactaatactctctctctctctctctctctctcgcggtcgccgtttccctctttctctttctcccccctttccctctctctttcccttccattttgtccatttttctgacaaatagcatgcaagtcctaacatgtctattttccaaaccatgaatcgggtaccttcaatttgtacttctatgtgatcaatgaggtggattcctatgaggtagactcctccagcattctgtctttctgaaagccttcctgtacataaacttaaaaccatagtggtgcacaacaaaaccaatataatagttgtgcctgtattattgatgcctcaacttagtttttgtatgctcatattccagaaaattattcctttttgttttttgagttccacatcaacaccatcggatgttacatatgctatagctttagagaaatatcaacatctcttatggtgtcccaaatcgcaaaaatctagtagcttctttaagctgagcaaatcacatctctgtcctgataccaactacctcactagaacccaaagaacctattggttggtgctatttccttgggaatggaatggaataatatatcttcctttcacttatgcaggattttgttagttctggaccatgcaaagctttcattaggttctttagcaattttcgctgccgtcctcttttcttctttgtgatctttgaatcaggtgaccaacatcatgtacatggatcatggaaaacaagatctactgaagatatgcattaaattagctatgaaaaactcattcaaactgttgcttgattactctttaatgcataccatgtctaaattttcatactattctttgtaaatttattcgtgattttccttatattgactaacatattgcactcttaatattttccatttcggcatgtacaattttgtgttgtcactggcaaggttctaaatactagccctaataggacatgcctttactgacatatggtacagttccagttgcacacagcagctgtatcatgtgtcactctggtggtatactgaaccctggtgccataccagcactgtgccgactggcatgccctgcacaggctggtacataaaaccatgattattagcatttggaagcttaagtaatttagtccctttgttgtctttcctctcacttttttgataatttttcaatgcagattctattcttttccctgaagttccaattgcactgcggttgtctagccatcttctgctaggtgtggtgaggatatattctcggaaggtgaattatcttttccatgactgcagtgaggctctgctgaagataaaacaggcatttcggtcaactgcagttgatctcccgccagaagaatctaccgcaccatatcactccattactcttccagagacctttcatctggatgattttgagctgcccgatagtgcatatgaggggtcagttttggattcttcctctcagagttcatgcaatatattatatcaatttctaatcatgcatttctacagtagtttgcatgtatgaatggggatgtggtggtttcattctgttgtaactgccgagctttattccttaactgcagcgactttgttgaccgccatgtcagttcgaaagagcagatcacacttcaagatactttggatggcacaggatattcgacattgcaatttggactggatggttggtgttcagttataaagcatgatgcatttaatgcaatttggttagtgatatcttgtccatgataaattaaattgtgtatgctgaatttgtttgtacagaaagatttggcgatggaaatgcttcgcagattggcttagaacttgatgaggtaaatgctaatgcatgtgtgcatgtacacatatgtgcatgtgcaggcctgtgcatagtgttcttccttgctttttgtcatgtaccatttggtggaaattcttcatttagttttttcccatgataatttatttctgattgtcaatgaatatattgtgtcagtgttattgatatgtccatttccagttgcattgattacaatttgggtaccttgaatttgtgttagcatggaagtgaagtcatgcaattgatccttaaatttcataatagatgttgaaattaaaaggtcaaaaaggtttgcaaaatagactttatagggtatatccatgagctacgtccttggttggttgaaattacatgagaattgggtgatttgaatatatcatatcttgccttcagtcattattggttaatgtggggccgcataagccttcagtcattattggttaatgctagggccgcataattgtttctgggagctatggtggcctagtaagcctcacattgtatgttttttctccctttttatatgggcatttgcaaggtatgccgtctcggtacggagacctgtactggtgccatactgttactgtgtattcacttgttctagaaacaaatgttatgaaccccaagctgatgcgcaaaacaaaaacaaaaaggaaaaaaatttctttcggtgggagagagacaaatgaagttcacctgtaaagagaaaagatggtattattattgttgtgaaatcttattttttatgtttttgatttgaccactgacaggacttattcttggacaagcatccctctcagcatgcatcaacttcactgggctcagataagtggtaaagtcttctgtttcattctttggcttcctttaatgttaataaaaatctcttttttttcggttttttagtcgatttgttccttttccctgagtctttctctgatgttctgccctcctttatgcccctaagtttgatattatttgagtaataaggattatgcaaatccttttctctcataacaattcatttttaattccagcattcagttaatggtaccttatgttgatatatcatctattgttggcaaccctaagaagcctttagggagttactacttaagtcttctagttgactgcaaggctcaacgtagcttgactgtttaataaattgccataatggagaatgtgtatttatgcacgtttacatgcatgaccaacaatgttgttttgttaaatattccaatcttccttcttcttgttatttgaacttcagaatatcaaattatactcattgcactgtattaaatttttcattccagtataccatgtaagctattccagttggaactttgccttgtgttgttaacgacaaccttaggaacatctgatggtgttgttcgtaactctaatatgttttccctcagtgctatgcatcagggccagtccttgttttctcttgctgacatggaaattgatgaaggtgaaagtgggctcaataaggataagagtgttgaaactccaaatgatttgtctgaacattctgataatcctgacaagcatgtacttccaagaaatgatggcacctcgcagtggcatgggtacaatattcaaactcctgatcttaatgaagcattttttccaagggatcatatcgaaggctccactgcaatacccagtcaaattgattttattagcactgctgatgaagttgcatccacagaattgattgaatctgctcaggctccatctactcctggtttaatggaagagacattttcagctgctgcacaggaaagtcctgttctgagtccacaaagaaaaacttcaccggtaactggtgaagaggccttgaagtctgataaacctggctcacattttgaatgtccagattcaacgactgaaagtggtcatatacaagcagtaacaatggactgtgagccggctaatattgtgccactgacctctttgcctacttcaagtgggtttgtagctgcagctgatgaacctcattcagaatgtggacagaagagtgcagataataatgtacaaaatgatatcgtttgtgatgaagtggaagatgtgatagttgccagtcagattcatgatgatggcgatgccatgcttcctgaaaatataccggaatcaagtgtgactttaactaccaaaagcacctcacgtgagggtaatgctgagccatcaattcttggtaaacaggattataaagaagatattgaccattgtcccaatagcaatgcatctgcacttaatattgatagtaattcgcaactgaatcaagccagttctctgtctgcagaagatggagttttagtagaaagcatccctgagttttctcaacaagacctgggaggctgttccggaacttcactgagaaaggaggcactttatgttactgaatcttcttttgatttgcaaggtttgtttgacaactttggatcttttttacttgctatgactgattagaaggtaaaaaagtggattttttagcttttattgcttttacaggtgaagacttcaacatagctaatgcaacaaacactgatgtcgagatgcaccagcagtcaggacatgcattattagaatctgtaccaggtgttagcaaaccaaatgaaccatcaactggccctatttcaaaagatacgcaactagatcagtttaactgttcttcaagttctgagtttcctgaacctgaaaaaatgctgttagccccagctggcaatgttgacccggctagcgaattaggacagcttactgcagaaaagggggtaatagagtctgatggaagtgtcaacaggatcagtagcctttgcggcaaaaaacgccgattaatggagagcacaccagttttgcaacatggcacttccacaaagatgtctggcaaatcacgaattagacggaacactgattacattcctgatgacgatgatttattggcatcaattttaggtacgaagttatgttgtgatgttctaaatgagatttggcatataaggatttcctatatcatgaaaggataatagccttgcatatagatacttcaatcttccttattatttgagtttaactaattgcctgattgtgccagttggaaaaaggacaccagtcttgaggatagggccgacaccgccaccccccaaagcagcttctctaaaacgccctaggttaacaaccagaccaggcatgcccaagaggaaggttttgctggatgatactacagtcttacatgctgagtatgacctgttccccaatgtttctctcttcatattcccatttaccttgcatgctgagtatgacctgttccccaatttttcttgctcttcatattcccgtttgtatgacatccatgtaccagctgttattgtaaagcctatctgaattttggggacaaaatgttctgaataatttaaaatttctctgatcaatcttcatgattttcctcagatttatctgacaattctccttttttttaatgattttatgcatgttatttggaatcgtttttggcaaaaacaatttagcaattcttgtgattcatcttgagaaaattatttcaatttgatttcccctgatggaggaaatgagtgggaaatgttaaaaagcatgaggtattagtgatatcttattcttataacaaaggaaattagaaaaatactgaaaattgagttttgaattgtctgaagttcctatctttctgacaactttctttcatgtttctatttttgcttctcatctcccacctgggggactttctggaccctcctcatttatttctttatcattttccaaatccatttctatgctttattgaaatatcctgtagttcttttggcaatcatttcatgaattattaggaacattcttttgtacaaatctgtgcatttattaagacgtttctggatttggcatcatttattgtgaatccagacaaattttaacttgctaattttttgattgacgagtattcctaggcataatttattgtgaatcctgattctaggactatggtcagaagtcatatatgttacttttccttcttttaaactcttaactgtgttgtttcaaatggtttatttattcccctttgcagtgcaatacggcaacaactgataaatgctgaagatatacgccgcatgcgtaagaaggctccatgtactcgtcctgaaatttggatgattgagaaaagtttattagaagatgaaattttcaatgaatctataattactggtgagggaatataattattttaagattcttcttttcttgcatattgtgacagattttcatgctttcattataaaatcaacatggtggtgaattaccaagttcattattaacatgttgattgtcctttatgttgattttaacattttcaaatggccaaaaggttttattatttgttaagttgagagtagaatttgtaaaattaggcatgtgttgtcttttcatcttgtataaaggaaattttgatgccaaagtctattaacttgtttgtgattagtttgctttttcataagagaatctacaaacgcgaaagggcaatgaaatactcagttatttggagaaaacctcaaaagggaccttgacttctttacaataatatgcatcacgtggatttccacttagatcctgtcaagtgtagatcggacgacagtagtttcatatcgatgatttgagccattggatgtgatctactatctctatattgcttacacaccaaaaatcttgtgatttggagagctctgatctatgcatcaaatagtcaaaaaattagacattttaaatgacatgaaacaatgcatgtttttttgaatacttgatgcataggctgcgggccttcaaattatatgattttttatgtgcaaacaatgtaagagcaatagatcacaccacacacacacacacacacacatgtacgagttttcacttctgtgtacacacatgcatacatatgtacatacatacacacctacatatattatggtgtttgaagtttatatggaaaacagttttatgactttgatgagtttgaagttcgacatttcatgaccctataagttttatgtgatttgtttttgttcaggtgtatcagtggagttgaacaccttacacaatcgaagatatgattctgaaattgatgaatctcattcccgtgctgacccatcaaaagaggctgagctttctagaagcttagagtttgttagagaaactagtgggaaagaaatggccgagtccattccagttatgccaaataaagttgatgttgaaacacagggaccatcaggcacatctgtagcagttgaggcacagcttgacaaaggctccagtgaatgtgatgctcaagagcatttaggatccctaactgatctgcctcagccagatttatcaaacaatatccaaacatgtgatattacaatgacggaaaacaatatgcaggacgaaaatgctgaagttcacttgtctacacctgcaacagattgtggagctgaagatattgcagttcacaagaatgaagacattgctccatcctctgagaatgaagatttgtgcatgcattcggagtggcaagcactgcatgggtcagtacaacctgccagtgagctctcagagatgaacaatgaagcattacagacgactgaaatcacttctgttataggcttagatcttgctgaggatgaaaccagaggtaggatggttgatgaaactgcactctttgttgtaaatgatgataatttgttccacactaacatgcctgtattgctacagatgcttccgtcgtggcaggaaatgggggcatagcagctgcaggaaacataaactgcccacatgatactcatgctgatgttggtaagattggacacacagagacattagtctctatacaagatagcagtttacttgaagttgaggtatgtttacaaacagactcgactactattagacatttgaactctactatgctagatgtggccatggaaggtagtgaaatagctgaccctgttgctgtaacttctcatcagactgtgcagggaaaagacaatggtttagatgctagagtagaagatggatctgtgatgcagaaaaacttgcataatgaagtgaactcatttcaaccaaatactgaaatcgaaaatgttccatctgcagttggagaaaattctggtttgcaggaacttaatgcagagggtggtatggatgtagaaagtgcttctgtggatcttgctgctgcaaaagaatgtagtgtaagttgttgacttatttaatgcaaacatgtaagaagaggcctgttcaaagatcatgtgttaaattgcagatgttagtaaagatttatacttctacagaggtatataggtatatgtgcacatccatctatgcgatccacacatgcccataaattcatatctttgaatattattcttactgtaggtctgtgtgacaactgccacattttgaagttggtcatattgtttattttcatttggcataattcacatcatctagatctctctttcattctccactaataatttttttttaccattgtgcaggattttggcagtgcagttggtggcaatgatacaggtaatcttctagtcatgatctagatctgcatcatttctccatttttttctatgaaaggattgttatctgagagatgccatagacttcaaaagaccacacctagagctataatacacttgcaccagtgtgccaatggtttgtctaagccttatttcagccgtagtcaattaaacataactaaccgtgttctttcccattaggctaacgtgtctttatggaaccttttaatattcttctcttttaagaattacaatccttgttgaagcaagttctatgaagttcatgctcgcatcttgttatctatatactttcgagttgtctgacccttctatactttggaaaaatctaaaccccttatttgtccttaaagttttgttgtacatgcacatgctgcccattttccttcatttcttcttcaattggttaaattgttattcttctccaatgtattttttacctttgtgatgccagatcttctgcacatccatctaatttttctgagggatgaatcatttcttaagttgttgtaggatcataacctattatttctgagactaaagtaataaatatgtttattctttattttctagaggaaaggcataaccaactgtttattaatttagccttctaaattgaaggcttgagaacttgtgatgtttatctttgtctttatacatgattttgtgttcttttccctgtgttatgagtcatctctatcgatcagaatttggtccatcatagtttgagaatttgatctagtttgatgttacgttgttaacccttcatgaactggtgccgatgtcttgaccacgataactgtcgatgagggagctagaacagggaacaaattagcatgaggggaaacctgcctcagtttttgcatgaaaattagggaacagccatccggctttttccaagacttgagatcatatggagtatggaatggttcaatatttggggaacatttggcgctgcgtcaacactattattcccttttgaaattctttggatgccttacttgaggacctatcatcagcatgatcgtttcttatatggaataagttccgatcagacaccacaaaaaaagggaaatagtagatatctgatctcagatcggcacttgcatggtaagacccttatgcgagaatgagaaaagagagtggaagacagagtgtccattcaatggattggtgttataggtgctttattattatgttatgagtctaggttatcaactaatggcaatagattaaacgtgcatccctttaaggaaattttggtccaccataattcctctgcaatagtctgtgtcacaaaatctcctcaagggaagggtctgtgggatgggtgaaaaagaaaacaaaagaacttgaggaataagaagagagaataagaaactatggaaagaaatggagcaagaggtagagtgtatgaacaggcttaccggtctttatgccccttgctacaatagaagcctgatttgtgggtgttgcttaagtgaggaaaatgataagtgtgcttaaaagaagccaaaatcgtgcacctcagacctgataattgaatggtaatccaactgattgacgactatatgttccttaagttggaaaaataataagtgtaccaccaaaagatgttagctggctgcttatttaacctcatgcatatttgcacccaacatgtgttgagtcttaaaattgtcttattgagaatcaaatgacaacagaaacagcaatttgacttctaaattaacatttctgttcggtaagttctctatgtcactgaccattcatcttgctatcctgtttatgaagtgctcatctgtttacgaagtactcaatcttttatccgagccattgaatgtggtctactatctctaaacttcccacacaccaaaaatcatttgacttgaagacctttagcctatacatcaagtagtaaattttttcacattatttaaaccagaccaatttttgactatttgatgcatcaaggtctccaaatcacgtagttttcagtggagaagcaatttagagatattacatcacaactaacgcttggatcttggatgtatggcccctatcatctaattgaaaaaagatgcaattctataaaagttacaatagctataatttgagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatatatatatatatattcttttttttctttttttgtggaaaaaatgaactagtttaaccatttcctttataacatcccaccacgcaaaactcttagtcagctattttctttctgcttctgtccatgtcaaaggtctttttgacaaaaagaaccagctatttatggtcatcaaagcatgctcgtgatactattttgtaggctcaaggaacaaagtgttataggagattagttgcatcatagttacaatgtgaaagttaattgaaaaggcaatgcgatattcactgtgacctaaaagtgagttggaggattcacatggtagatataggcatgtttcagcctttggcaattgattgatttagcacttgattttcatgtaaatgctagttctgtctgtctttgctttggcatctatgcaaatatatgggaagtttgttttcattactgactttcataaccttcttccccattttgtgtatcagagtttcttaatgtagatgatgaagccgactatgatgatgcagcagatcatgacatgccgaatcctgaagaggcccagtcagttgaaaacagcggctggtcctcccggacaaggtaacctcctcaacttgttgtttcatttatgtctattatttatttctttttgccagtgactttgtgaatgtacactgaattgtttgtatcaatcttataggggcgttgcaaggtatttgaaaattttgtttgatgaagaatctggacgtggcagaaaacttgttgccatggatcgccttttagctggtaaaactcgcaaagaagcatcaagaatgttctttgagactttggtatgccaatcttctcagattttctttctggctgtttaaactcaatctgtcttctttcagttaaatgttcttgcaagcaacaaaaatgtttttgagttaaatatctcataatcatatgttgtgttatactgacacaacaaagttatatcaaatacatatgtcatacatgcatgcacacatacatatgtatggatacaagatataggttagaagacaaaatccacatgttttacatgggtataggttgatgcacatgacacattttgatctccttatcattatagttatctaatttgctttggtgaggaaggccgacatgctgcattgtatattaactgttaccaatgtgtaacatgggatggctttcatcttcctaagggttgcaactcctctttctaaccatataatttttagttggactaggtccaccagtgagctggtggatcagtccaaccatgaagcaacatgcacgatcagtccaaccatgaagcaacatgcacggaagcatgtgtattgcgctgttttctgttttgtctgtccatgtgtgtgttgctccacagttggactggtcccccaattgagcagttgacctggtccaaccaataaccactcctttctaacccaccccttaatcttccactgccacctttctcgttgattatgcctcagcttctgccactactttttgggcttccttaacctagcccccacattccttgttgcttagtcatctccacttccacaaatctctcccttttccctggatatattttctagaagaccatggatcaaatttgctaccatgtgttgtcataaatcaggtttcagtatgacccctttttgtcacaaactaatagcttccgtaaagagcatcaaccaacttaacacttccaagcataattgtgttctacaaacataaagaatatacttttgagtttcatcaattatttccttgtgtttctactatggcattcttaacaatggaatttcttgatgagatgaaacactcagacacacatacacatgtctgtctggagaataaaaatctcaagtcatgaagtgtaaaattaattatagaagtttatgattgtggatttcaatgctgatcattatctgcaataatttaagtacctagagatctataattatatattttggaggtgttttatgcattgagctgccaacaaatggagaacactaaaagaaccagcatgtgctggaatatgtttttcatatagaatctgcatgtcgattattgatctgtacattctagaatatgtatttcgaggcctttttcatagatttggtgtttttaagccataattcaaatcaaagcatcatatcatgctattgaaattgaacattttgtgattattgatgcgtaagcaggatatataggaatgttcgatttccagtttctaggcattttagatgctttatagcaccttcgttggtttcaatcctgctatcaggaatctctctctctctcactctatgcgtgtgcgcacgagctttcatgatctattgttcctgtcattatttttttgaatatcagcaaaattcatattttcatctgcccctctccttttttttttttgcattgatttgtactcttttgcaggttctgaaaacaagggattacattcatgttgaacaggacaaccctttagaatgtatcaacatcaagcctacaataaagcttctgaagtcagagttctaatccaacaggcacacaataatataaataaccttgtatttctaatttatcgtgatgcttgctccacccttttcgttgttcactcacctcgttttgatttctacaaagtttttatttccttttattgtactgatctcgtagcttggggtggagtggagttggtgcatgtgtttgtataccaattatatactctgtatatatatttgtaaattaaatcatttagtgttggtattctgtgaagttaactggtcttcatgttccttcaatcagaaagttcttttggacctttggtaactgtttaactggtggcttagggatgcaagttgtatctagttgatgatgatttcaatacccacaacaacccccctgcagcaattgatgcagcctgggtgtggtttggatgttaataaattaagttcttgtctattcttaagggtggtgtggatatgttaagttaagctcttgtccattcttatgattttccagaactaaacggttgagctaacccagtacaaggattttgaaaaatgataacctagcatgttttttcaaaattgatcaaagtatcatgtaacactaaagggatggtaggaattttttaggtctatattagttatttaatctattgattgatggttctaatcaagattattattttcagcttgaccaagatgtgagattgagccaattttagacaattggtgctgcattcttgatgtgcatgtgtatatgtatgtatgtatcatctcttgcttcttatgtttgataggctgctataactcaaagtgagacttttattagtttgttatctttgagtttttaagagtaatgagtaaaatgatttctactcgtcttatttagtattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaagaagttttcagatattaatgcatcatgtctgatcatgaaggaagagtttgtgcttatttagcctttctttggcagcactgctccgatgatgatagcacaacaagacctcttttattggttaccgcttctgtagacaagatggttttaaagaagccattgcgtgtagacacggatctgaaaatagaaggtgctgttacatgggttggtcgttcatccattgagatacagattgaagttactcagtctcaacaaggtattctgggcaatatatgtgttgtttataaatgaaatttgaatttatctgaccgttgaggttttgtccattatgtggcagataactcgataccatcagaatccatagctctgactgcaaatttcacatttgttgcacgtgattcaaagactggtaaatctgctcctgtaaaccgcctgacaccggagactgaatcagaaaagttgctttacaaagaagcagaagcaagggataaatggaggaaaaggaagagagaagaacagagaagagaaactgagaatggtgggcacagatttcatggcgagaaactaaagattttgttggcagaggggcgtgtcttctgtgatttgcctgctttagcagatagagacagcattctgatgagggataccagcctcgagaattctctgatttgtcaacctcagcagagaaacctccatggacgaatctttgggggctttttgatgaacctagcatttgagctagccttttcgactgcatacgcctttgttggacagatgccttgctttctcgaagttgatcatgttgatttcctaaaacctgtgagtaaccaactcctactgcattatcagtgaagtaatatctgctattacttctaatttggtttcttttttccctcttaaatagacaagaaagcttattggttaactgtaatctacttgagggctgctggtttttattagaaccgaagtttgttagtttgttttcctggtatcatcctagctgatggggagtaggttatattgtcaccatatgtctggtatttctagagaatttgagtacaaatgtcaggagatgtaaccgttcattatacattcttaggtggatgtgggagacttcttacgtttgaagtcatgcgttctgtatacacaactggagaatccacaggagcctctgatcaatattgaagttgtcgctcatgtaacaaggcctgagctccgaaccagtgaggtaagcatttgaaggaaacctggaggtagaagtttactataaattattcaattcaccatggatggtcattgaattaacccattaaatttcatggataattgttctcttttggcccatgagcaggtatcaaacacattctacttcaccttcactgtcaatcccaatgccttgaagaatggactaagaattcgcaatgttgttccagctacagaagaagaagcacgccgggtacttgagcgcattgatgctgagacaatgtttagttaattcataatctagctatcttctttagtgaaaggaaaaatggaagttccagaagtcgtgatgcttaattttgaataatgtagcagtaaatatggaacaccatgtgctttgagaaatcaaagaaggattcatcttatcatttcaactagatgctatactattctgatgagaaagatttaatgaagccagtcattttaaatgttactactagcctcttttatttgtgcccttgcccctggcttctgttcttctcagggaaagcattggttagtgactggattccatgcattacctgtgcctaatctgtttgtcaactaactacaaagttggaccaggatttatgacctgactctgagttggttgcatgcagtaaatcattttccatgcaatcaagcatatttatgctccagtaccctggttggcttctaaacactcaaacaagtataatcacatgttgatagttttatgaaatgattaatctcagaaatatagttttaatgaatggcagaagaaattaatatttttccaatattaagtaaaccataaaaataataataaagcttacaagcaaaatccttttttttcgttgagcctctataggaaatattcctggcaagggcctgatccctgggattgaacctccgacttcttgtattgcttgtcatgttaagattactttgtattgctcaagtacctcctgaattcctgcagcctttagggtccattgaaaaaaataataagaaaaaggaagatgaggaaaaaggttgagaaatcaaagaaggattcatcttatcatttcaactagatgctatactaattctgatgagaaagatttaatgaagcctgccattttaaatgttactactaacctcttttatttgtgcccttgaccctggcttctgttcttctcagggaaagcgttggttggtgactggattccatgcattacctgtgcctaatctgtgtgtgaactaactacaaagttgcaccaggatttatggcctgactgtgagttggttgcatgcagtaaatcattttccatgcaatcaagcatatttatgctccagtagcctggttggcttctaaacactcgaacaagtataatcacattttgatagttttgtgtaatgattaatctcaataatatagttttaataaatgatcgaagaaattgatatttttccaatattaagtaaaccataaaaataataataaagcttacaaaagcaaaatcctttctttttcgttgtgccttgataggaaatattcctggaaagggcctgatccctgcctgggattgaacctccgacctcttgccaatggtaccatccaagctattattcaatggtaaaaaatttactcgaaaataggataagaaatttcaaatgccacttttgtgacctctataaatatcataatctaatacattccaactatactgttacaactcttattcatgacgtgcatcaagtagctaataactttatgcatagccattatgatgttgcacccaagtagttcactggaatttcattctttctaaaaaattaaaaataatgataataaaaaaaaaaagaacattttcaactaatcttgtgcatgttaagatcactttgtattgctcaagtacctcctgtgttcctgcagcctttagggtccattgaaaaaaataatgagaaaaagggagatgaagaaaaaggttgaagttaaaaacagagagaaagcaatcggttctattcatgtatcaaattcatgaaaaatgaattcgtctcgttctaaattatcttctccattataatttctagatatttagaagcaccaaaactatctttcctatttttttgattgagaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggcagaatgatttatccgctgccttcggtgtgaagttaccctatgatcaagtcatcgaaaggatcccatccatcatttctaaaattaaaactgttattaaggcaagtctatcctatatatcaaattcattgatagttcataacctcaaatttgcaactatttgcattagaaattttatggtttaagcatagcaatagcatgtcatagttataatcagatggaaaatctaaatctacttgttagcttctttctgactatgctcaaactttcactatagagccccttcattaactgatctaattagtcaaggattgctcaaataattcattttctgcaagaactctttatgatagtctctttcatccatagttgttttataatgacttgggagattgtagttgtttcaagtcatctttagactgctttatctattataattaatggcgataaggccttgcctctctcgaatgcagactttgtatggtagtggtggacctccatataactttaatcagaatgtaacaattttttcttaattttcttttttaaaataaagaccagtattcaaggatcttcttttctaaaaacattaaaacaaacaggcccatcaaacccgctggcataacgggccaacgagccgtgcctaatacggcccaccatccttgggccttggatcgtgccaggccaggttttgtttaaacgggccgtacccatttagtcgcgcccggcacggcccattgcgcgcgtttgctcatactagtcttgtttgtgtttcttaacatattttcggttttctagagagcaaaggcgatgatgagttgtggtaacctcgaagaaacaatactcatgcaaaccatgaaatgttatatagttcgaataagtctcgagactccaaagtttattcaaaagagtgctcaatattctccccttgatatataaatatctagcactctaacaagttaatttttatatcattgcatgtccggtcatgcaaaggtcaagcctaaaaagcaagccatacaggagcgtgcggccattagctaaattttcagttcatcttagatcaccatatactcacttctaaagctcattacttgtagcttcattgattttttatgtttccttttgaatcttttctatgaggcatgctttctttgtgccttgcaatttgttgcagcctcataaaccatccaattctacatcagccatagccaacccagacccagaaaactcatgaagtttagtttcaaagatctttaaatgatataattatagaaagaacataatgtccacctcataggttcatatcacctatactgttaagttgacactcttaacaatgtgctgcacaactgaaacttgttctggataccgcacattgatcttttgagaagaaaagctttcaatagatatacataatctgagtcaaagaagacagtttcccaacatttctctcatctagatttcctttctgtatatacatgggcataaaaattccaagaacataatgtctgcctcataggttcatatcacctataatgtaagttgccactcataacaatgagctgcacaactgaaacttgttccaaattctgcacattgatcttttgagaaaagctttcaacagatatacgtgatctgagtcaaagaagccagtttcccaacatttttctctaatctagatttccttgtgtatatatataggcataaaaattccaagaatcttttacatccatattctacaggtacaaaaaatatatatataaataagtggcattttgattccatgtggcactgcacttctcagctgatagccagcaaaaccttctactcgaaagaggcatcagccaggagcactaagcgttaagccttatgatgacaatgaactttcctcatcagagctttcaggcctcaatgcctggaaccttgggaatgcatgtggtagtgttggatttacaggtactgggaattggcgtgctgagctgacaatggtgcgatcatttatccttccaacctctttgcagacctgatcaaggatggctagaaaatccctgaccaccatgaaaattctgaaagggtgagcttcttctttggctgagttgccatggaaatactcggttatttccttgaccaaagacagtgcaacactctcatgtgcctggattttaatgatctcgtcctctgccttctttaagaacccactcatagcatcatgaaattgctggctattttcctttgaattcaaggtttcattcaatcttaaaacctcagttattttcccaatcccaccagcaagtttagagacatagctgctgagcacctcagaatccattgtggctgctttcttcacattgctgagctcacacccaaggccagcgacagcttggaggccaagctttctgcactcaaggtcatctcgtagagtatttgcctgggttttggcagctgatggggtcacggcagaaaggcgggagccttcagatctgatgatttcctggacaacaaaatgcagaagagtagtcttgccatcggtgcctttgacatcaactagcttgagtagtgtgtcaagcttaaaggcatgtgcatcaccacggttggtaccaacattcatgcggttcccggtctttagaacggcttctagaagcttcagaaacaatctgctgtttctcagatcatcacaggctgcctgtgcattgcaatacaagcagtttgttagtccaaagaatggctgcaacccaaagagaacacaaaaatgaccattgcctattacatagggcctgtctgatctgtccatttacctctgacactagcttctttgtacaagtactgattgaattttaatgatgacaaatgcaaaattcaacagcactgaacttaagtttccatgcagtttcatacacccgggaaaccaattgataatgaagcagttctttcctcaacatggtgtagaaatggaatgtgtgggtgagacgaaaactaggaggacatggaaagttggaaacattaactataaagtgaaaaacaagttctaattataagtgttacataataacacaaacataagtttgtttgcaattcaaataggatattgtgaaatttattctcataatcaagtgtaaagttgttgatattcttttttacgtggtgtgcatgagcacaagatggagaactctgaattactggtaggtacatttagtcaccagatatatgctctcttctagtttgttttagtgatgatgggatgcatccagtttgtggttccctaaattttcacattttccactcaatttcaacatgattagataaggatatcagtgtcaatgattatcatgtatgaattatgattgagaaagatctttgtttatgcagatatattggcatagtttctaaaaaaaagatatcaaatctcctgcatatttagaagaccacaattctgttcataagtttttgaactatccatatttgacaactcaattctataacaaaccaatatatgaaaaagtattgatccattcataagataatgatttcctgcagcgcataccattagaaaggccaaaccttaagtgccctgcttcagctgggtaagtacaagatttcatattaagatgccaaatggaatgcctatttggcacacgaattcatattgagcagagtattattgtacatactagtagataagataaattagaatgtttggcagaggaagataagttattaaactttggtttaactgggggcaaagggaaggatcaagagatgaggcagtagcagcaaactctacatgagaaagatactaacttgagatgaaaaacaattgatgaggctataatcattgtatcaattgctaatcccttcaaggtcagagtgtcagactatactcaaatgtacttgaacattttgtcgattgttcaaattatgaaagaaagactaaaagtttatattgttttaaacaagttatgcttcatgtatgggaaaataatcagtgcagaggctaacatgagcattattttgttaatctgaactctcaagactatctcttctgtctttagtaaataagccatgaacgctgcatgatatatgacattacttcaatgaaaattttgctggatggcaaaagaatcaaaagcagcaggtcacatggaagaattgcaaagtacatacataaataaaaatttgccatagtatcatagcttctggatgttttagctgctctgaacacagtattgcatgcaaccctgatcatgggtcctgactcacaggtcacaacctgattactaaagcagaaaaagatcctaattttgcttactactaaaccaaacaaattcttttaaaccactactttatctactattttactagtgattgacatgcgatagttcacttttttcctatccagaatagaattgacaaaaaacaataaaaacattagatttacctcaagagtttcaaacgatttcttaagataattgacctctgaatcaaaattagcaatgtaaagcatcgcatccactctcttaaaagcaaacggtatatcaagcactgccttgagaaacttttctgcaggaccaagcttgatcggggaatcatctttgtactctttcaatttaagctcttcttctttgcttggagccatctttagcaaagtctccaatagctcagttcctaagctatctatattacctgcaattactcggtaaaacatatataagtaaataatcaaccacaaaaataccagtaaaaataacttcatttgagttaaaattgatatacagaagacttcaacaactgaatggctaaaacaaatggttcagaaaatattggcagtaagatgtccctgttactgcatcaaataaggtggggagttgtagtccttctagacaggtaaaggtcaacgaagagaacaagaatagcatcatcaaattcataaacatagatacttaaaaggcaaacatgatacttgatattgcatttcattatgcatgaccaaaaaaagaaagattaaacagctacaattgatacatgacagaaaagtttgagcttgatgcagtcatcactcttcccagcctgactacaaatttcaattatcttaattaaattagttttgttcatttgtcaactaacatgtaggttaaacaatatgatgccaagacgatggagcaaaggatcaaattgaaagatccagaaggttttaaataagttggatacattattgaaacaatttgtgatacgctgagttgacttcctggcaatcattatcagcatatagattgctaccgaacagcttttttattttactatcattttgacttacatttccaaacagctgttgatctcttcgtgaatggtgagcagtgatgcctactggaactaggtgtcattcatgggatttacttcaataactcatagtgttccagtaatttgtaattcctattggcaattatatgattgaagagaaaggtgtgttttgcaatgtaggtggtgctgaattaagggaaaacaatacatattcgggttttctgcttggcatctgtcaagctatgagcatgctgccaaatacagaaaaagaagcctatttaaaggggtgctttaatcacatgcctcaaatcagtgacacatccaaacatttatgctcttgacccaagaatgtgacattataactgatagtttccacaacaaaactctagttaatatcttgcggccattgggattaggaagctcaccgaaacaaaagaagcaaactgatgttctttcacaatgatataatcatcgaggaaacatgatcgcgtaggccaacaaagaaagaacacctaacccttggctaaaatatagaacaataacctttttggaggcaagtggcaaaggggacagatggttacatgtaaactccaaagcaccatacctcaccatcttttgatcagctcagtcttctctaaaagcatcatgttgttcttttactttttgcttgcattagcagcatgcaaatttaaaatcaagaaattagctgatctattttccaacatacaccgagattgagggagagtttatacgtgaataggtggatgaaaagtaaaatctataattttgaataatacttttttcagtgccttcatattccaaatactggaagaaagtctggtacaaacagttcataacggtgatcaaatctgattaggaaaaaatgagcactggcgtagaacatgtcggcgcaattaaatgcgaatgagattcagagcaaatggctaaagaggtttagtgtctcaccttccaatagggcttcacagacttcctcctttgtcacattcagtgccctcaggaggatagcaatattctgagacttcttcggatcaagcaccctgttatcttcatttggaattggaagcacttgtcgcttgttcgtctcctttggggctgtgtttgttgcattgcaaacaaacaaagtctcaatcatctcctcatttactctgtcaatagataaggcgagagtttcaaaaaaggaagcatttttatcacaatattggtaataaagttcaaaaagagaaagagatctaaagttaaaaacacactggaatgagctcgatttcagctgatcccacaccatttctcgatcagagctcgcccggaccttatcccagtgcaaaggcttcaactttgggcgaggggtctcctcgctcttctccactgcatccgaattcaccggagattctgctgggaaagccgctgtggaagaattcttcattccagtaggtctgggaggagtgagaactggaggctggctagcctgtggctttcggatccgactctcccagtaaccaaccggcggcggcggtggcggaggaggtggtggtggcggtcgcgatgcagctggcctcgacggtgctggcagcggaggagcttgcctcagtggcggcggcgggagcggcggggcttgcctctgcggggggctaacaacaaatgggttcctcgagaagtccccaattctctgcggcgatcgcaagttcggacaggagaagtccgagatccttgagtttctttcttgatccttctccaccggtgaagaaggtggggagggagaagggggtttcctctttggaggcgaaggagtcagcggcccgagcggcaggcggggcggaggaggcggcagtggcgggacaccgaggtcgaccaactcagcattctcggatctaggtttcagagatttgacgctggaccgtgccgggctcgatccgatcggcggtgacgaagccgccggcgatgatggactcggagaagacaccgaattggacgacggatacgaaggcgtgctcagcgtggagctccgggacccacatttctccatcggggcagcgacggccgggaaagtccgctgtgaggtggacatccggccgccgacgagacccccggagctctccttgtcgccggaagaccctttcggggagtaaaattcctcctccgacgagcacccgccgtcggcattcccgtattcgcggcgagcatggcgagataaggggggaagaggatggagctccggcgagcccagcttctggtagggagaggtgttgggccgggggacggacgcggctggggagggatcggcggcagctgtggcggcggcggcggctgtgcaggagttcacaagggtgccgaggtagaggaagtcagaggtggggggcttaggggcggcggaggcggcggagccgggggggaagaggcggatgctgtcggaacgggcgttcttgtcgtcatgggacgggagacgacggcggcggcggcggacgaagaaagcgagggagaaggcgaggaatccgagtgcgaggagggggagggcgacggcgggtacgagcttggcagcggaggggcggcggggaggagcagaatgggaattggggaagatgagggaggagatgttggcggggagggaggagccggtggcgggggaggagggaacggaggggggaggcgtggaggggtataatgggaagaagggcttcgggttggaggaggaggggtatttcgggaaggatggggatggtggctgggccggcggtggggtggccacgggaaagaagggcaggtggagggcccgccgtggaatgggcgtggtggatgagaccgccggagtggagaataacagcaggaagagaagcaagaagaaggaagggactggcatattgtgcaagagacgaatgtgagagagtgagagagagagagagagagaggtggctctctgttttcttaatggtctaataggagaggaagagcagaacaacggtatgatcttcttttcttttcttctccattttccctttttttttttttgttgcctcctctaccttggcttcagtaggaggaaggaaggagacgagaagatcatagtagcagagcaagactaaaacaattaattattttctcacaaatatttatttatttgggagggttgtgatgtctaggagaggtgtaggtgtctgtgaaataagatagtgtgagacgaatgaaaggggggagagagagagagagggagcattgcttgtaattatttgggcataagcagtggggacagatgggaacggagtagaggagggtaggcttggtggtgggagcgaggtgtgaagaaggggaggtgagaaggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcaaccggcggaagctttgtccacccaaggaggtaaaaaaatggacgacactcgcgttgggaaatgcccactgaaggccgagaaaacattgtcggccggagagaacaaaaatgtggcggagatttttttttttaaatgattggatctgatgatgtcaggatcatttgtgcctgtgaatattataaaatattttattatttaattttaaaatatatattttaaatataaaaaaatataaatattatccatttgaatttatttttgtatctaaattaattcgaatatagataaaaatttaaaaatccaactaatatatatattcgtattcatatctatcaaaaaaatatggatatgaatatggataaacaactatccgatctgtatccgaatatccaaattttcatgaaatcctatataattttatataatacttattaattttttaaaaaaatatacaatcatataaatatattattaatttatcatatatttagtaatatttttgattgtatagtcataaaatttaattatctaaattatatctataattatatccatactttcaatattcaaattatatctatatctatttaaaataaatataaatataaattttttcgttcaaataatatatatctatatttatattaaccaaataaaataaatataaatatagatatattgatatttatttcgtatttgatctatttttgatctcaatgtacttattttaaattggtacgagcggctgtttgtatagaagaaaaaaattggcgttcatgtggctataaaacgaatgtttaaaaaaaaaaaaaaacctcatcaacactattccatcaggaaagaaaaacactattccttttatattatttttctctaaaagagctggggaaaaaatactttttaattattttttggtagcctttaccaagtggaccccgcgtctggatctctgggaaacgacaagagaaacgggaaagcggaaggaatttgaaccttaaagtgcgtgaaacgggaatcgcggcgtggagtggttgcagcatgtgcgcgccccaagtaggcccataagttaggattctcctgggaggttccaggggagcgacgtcagcgggtctgcgaggcgccggtcacgaagtgtgcacgtgacaagagctgcaaatgggccagcatttgagtaagttggggacattcgttttgttttctttctgatgaaaacaagtgcaaatacagcaccgtctaatttttaatttattatatggttttttacgaaaaaaactatcaaacatgatgaagtactgcatgaaaaggattgacgtgcgcgacaaaacatctgtacactgaattctttggcagtggttggatagatatcaagtccaccgaccagtgagattttttttttttttttggttaggagaccagtgagattaatttccatccattatcatataattactggagaattctgctgctcgactttttttatgagatgatacatgtttatagaaaaattaataatattattgattgaatagtaatatatatatgagaaatcatatgagaattatattgtagactgctgtaattgatatttcttttaaatttttatatattttattttttaatttttatggatgcattttcattagaacggtatgaaaagtttggcttatcaaaaaaaattatcaagtatcattctattcttctctctcttgcttgatctggtataatacccgatgaatgaattaatctccatattgcattttgtgtcaaaacttgaccatcaactatgatcaaaagtcgagcattgcatattggtactattttcatattacaatgatatttccaagtaacgagaccacatattttaacacatttgaagaaaaatttacatttagaagttccatgttaagataatcgatggcaattcatggcgtatggccttaattaaaatgagtgttctcgccctaacaacctcaatcaaaaaagaagttgataatagttaaggtgagtatatttttattttagcaaataacaggatctaaaagagatgtctatactcatgagtaagatgcatttgatagaaaagctcactagatataaaagactttaaactttcacagaaatagttctttttggaacaggcttggtcaggcaccatagctttaataatttctactcgcttcttggtttcaacaattttgtcttgatcccttgttaaaaatcccacacaatgtgtgggtcttctccgtatctgacaacgcagttggtgggaacaattgttatctttgaaatgcccatgtgaagttcccctgtatctctttgcaacgcaagtcctctgaaccttcttgacccttaaactgcacttctcgtgatgactttagaatagctctcagcccaaaggtttttgtaccccggaaaaatggtagaactccatccagtttctttttgtatgtcggtctaatcttctttcattgtggtagtacccatcaccaagtaacttccttgattttgctaggtggtctaagataattaaaggtcccttcaggtatatattggttgggtgatttacacacgatgagccattttttaagaggaagatttacataggctaacttcgtattcatatataatttaataatcactgaggtgataaatgcagtatatatgaagatcaattgcggtgatagcacttacatacaacatctgctgctcctcatactgatattctttttcccgttgaatgcatgaaactattggttttgaaagtttttaaaattctattaatagttgcatgagatcaaaatcagtttgatcggatttggattcagatccgatcaaatcaaaattttatataatagaaattttatatcaatgatccaaattattgaatacaatctaccatctcaaaattacttacacataaaatatcatatgatctagagtcttctgatctatgtatcaaatagtaaaaaattgagtagtctaaataaaattgaattatatatatttttagattatgataagttagagattttcagatcatatgatttttgatatgtaagtagttttgagacagtaggttacattcaatgacttaaatcattaatgatgaaggttctctgttgtctaattttgatctgactgaatttgaatataaatttaattaatttaattaatttttattttttattaatttatagaaagttaaaaattttctggccaatttatttctgtttgttgattttttaaaataaaaaataatatgatcaggtaggtcttaaatctaaacatcacgttgctgttagattctaatttaatgatccaatcttttctctggagcttcttattttattgcatggagtcgacctccaatccctatgcatgggaatattgatcactcgaccgcaccaagagcacatcactgacagcaccaaccgccattaacaatgcaagaaaggtatcatttttatattattattactggtcgtaatctatttgtttgcatgtttgtttaatcttttatggaccatcaattcgagcacgcaaaagcacgtagcttccgggtctgacgcagtgctcctggcttggggaagtggttccagtgcgaatatgtttgagtttctgggggacattaataattattatgattatgtacgagatcacgtgagtaggatggagagacgctaacaagttttgttcttcgtgccataagttattaaaagcattgttgttcatgatgcaacatttgacgaatgtcatccacgctgttgttctccggtcaaagtccaggagcactggtgacgcccaaggctccaaggctccttccttttggacctccatcgcaagtaggggcagaaataagtcagatcagatcagatttaagcttaaacagatcagatctatattataaaatattaatttgaatttaatttattaaattaatttaaattaaaaatgagactcgatctgatctattttgtaaaataaaaaaatctgacctaatctgaaagtctatttaaaaagactcttttatcttcttgattctcgaaaagatcaagataattgaatattgatgaataaaatcaataattaattaattatatatattaataaaataatattttttattaaattatatatatatataatatacagaccagcctgcagactttcagatcaggctttagaattttaggcctgacctatttatttaaacagatctttttaagagtctatacttaacttatttagataaatagatcagatcaggccgtaggctcctgacaggccatctggtctatttccacccctaatcacaagagagaaagtctctgtacaccataataaagttgacgtaaaacgtatcaaagattatagttattatttttttaatatatatttattatttataattttattttttgttttaaaattttaaataataaaaaaatttaaaaaaataatgatgtattataataatattatgatatcctgtaatcaaattataattatatatatataattttatatttttttaaaaattatataaaaaatatatttttattattaataatttataaaatttttaaataataaaatatttttttataatattttatatgcagaaagtcataatttaactataggatgtctgacagcaaaatattataatttttttaaaaaatatttttatcattcaaaatttcaatcgaaaaataaatttataattattaaatatatattaaaaaataaaaaatatgttattcaatcagataggcaacatattttttttatagcaaatatgatgtacaaaaaattatactttatcataatagtatccctcgcctatatgttcggacgctaagtggcgaagatttgagaaaattaaaaaaaaataatggaggatggcaaataaaaacttcaaaaatcgctactactagaagtatttagtgacagccaacgataaccatcatgccagctattaaaaatcacatcactataataattatatagatatctaataaaattaaaagaataaattaatatcattatcatctttatcattagctatttaagtaatataaataaaattaatatatataaaaataaaatattatcctgtacgagaggaagaagaaagagagggagggatagcatccagtcgttggaagtgaagtaggggacagggaatggatgctagcaaaagatctctttccttctggaaaaattaatccactttcacacgtttcatgtagtgctatccagtgatacattaaaattgatatccatatctcccaagttactactcctctgtctaaaatcatttgcatatcatttccttgttcaatgcatatcatttgcattcgctcctccaacatgatgctatgattgctaaatataaggttttttttttaatccccagccaaactatgctaatcttcatgcatggaaacactaaatagagtgcaatatatgcacagaacttatttattatgattattggtaacgatatgtcaataataataaccgctggtggatgacaaaaaggattcctttctatggattgtatataaaaagtgaccatgttaaaattgggtttattttcagaactcgcaaaaatttccatgaacttaattttctgaagcgcttaccatgatttctaatgatacatgcaagcacacatggtcacatacatgaatgcatgcgcatagtctaagcaatttatgtataaagttaacccttcacggttgcttgcgttttttctatgggcaataaatgcaggtagatggggatgcaggggtggggacaaaatattatgatgttgcaatgctgtcatatcaataaaaatatagaatactttgattcacaccgattcaaagcaataaataataataataataataatggagtaattagccgatgggattccttaaaaaaataataatattttttttgaaaaaaaaaaggcttcaagacaaccacaaatacatgcatttgtctgcttgtaacccttgtcaattctgaatttttaatgataacagctcaatcatgggctccaagaacagagagttgtggtcctccaaacacacatgggcttctaatataaaaaggaaatatggtagaatcttatagctaaggagctttgctgacaatctaagaagaaggttgagtagtgatggaaggcaaagggccctgcaaataggcaagagtaattttattctaaacaggtaaataattacagatacacaaggcctaaagaagaacattgatggttgctgtattgataaggaatgattcaataccagatccatctgtcatttgagaccacaatgatgtctgttgtgataccatggcctaccatcatgacctcttggaaatgtgatggaaactaaacctgctgacctaccactagctgcagtagtatatttatggttatcccagaattttcatgtttggggaaaaaattctagtactgaaattatctaaactaactttcctaatgttgcttgtgttgacaaaagaaaaaaatgatcttggttctggatttgattaattaaatgtatgagtaaattatcttacttaaaactagtctctcttggaaaagaaaaaaatcctacttaaatacattaggttctggatttgatgccatccaagtctgattttgttaagatggagctggccatgaagcccaatttatgcttaagggcctccatatagatatgttgacagattgttttatgtgttatcatataacaaaaagccaacacatttattatttacaaaggagaaaatatagctcagcacccgttttatatctaactagttttgagcccgcgcattgcgcatggattctatgtcaggtaattgatcatttgtttaagaaaaaaaaattatgaatagcaatataatcaccatttaaattcctgctatcagtaacagaaggctttataacctaatttatacttgtaaatgagcttcattgccattctttaaccgtacaatgcttttatttaatgctttaaagtgagctttaaaactatcctttaataacataatgttttcgcttttagctagtatggtattgtaggttgattttgatctaaatggtatttatatgtgagaatgtattgtttatgtagataacttaacttgctaatgaatttttttttcaatttttactttcatatatatatattaaattatgttgcctgctaaatcacttattaacatctaatgctgacatttgaaaggatccattgacaatttatcataaacaagaaaatatcagcaaccattaagaaaacaaatgctaacagtcaaattatggatttcatatttcatatttcatgaggcagcttgaagtttgcaaagatcagtaccgtttgttgcatggagtaaatcaattatatcggtctatgatttaaaataaatattaaataaaaatatatttatagagaattataaaaaaataattataaaaaatattaaaaaatatataaatttatttaaaaaaaataaaaattaaaccttacaaagatacctcacaaaagaatcttcatacgcacaaataatctctattctaattttcttcttatgtctctcgtacacttttacatccaaagaaaactctaatgattcttttaaatagaacattatatagatgaaagtttaactcctattttgattaaaaaattaaaaatttattaaaatataaattttaataatttttagaaggaaataattaaatggagtaacattggaaatagaatcttaaagttattaaaactaatcatcaactaaaaataaaattctaaatgaattgagacttgttgatgaatctcggcaataatgtattgttatggtgctggaaaatctgaacctaattagtggttaatatctcaattcaaatttgggtcttaaggtattgagcattggatgcctttattccttgttggatctacccgaggtccaatcgtttaaacccatcatcatgcctaccaaaagcttcttctttggggacctttagagccacaggcatcatttttaattttttttaagggtaagaacccacaggcatgtttaaagcgaaaggatgctactggagatcgggaaacacagaagagttcatgttcatttctaaatttcgaccgttgctgagggaatcatgtccaacgtttcgaacgttggcgcctgctttatattaaaggtgcctaaacattctgttagcagtacaatgcaaggttttgggaaagaaatttcaatattataacaccaaatggagcaatcatgtttagttgatgtatatatacaacagttgttttttgattttttcttttttttcttttcctgacttgaaaaatacagaaggaacggaggaaaattaaccgagtggagtaacatgaaatattcttaattagcattcttttgtagaaaatgggcaatgactgcttcatgatggaaaatgtggctgttattgatccttttattgttcgccagattgagaaagtataattttagatttaaaatcttcatgtcacttaaaaataatatttacttatatttttagagagaaaagtaatcaaacaagctttatcatcaattatttttttttctaaaaatgactaataattgatggattagcccaactacgaagcagcatgcataaagtcggacaaaatgaaaaaatatgtgacacacacatttttgtgcgtgctgctttacggatggatttgtccgtcggctcaacaatgaataattaatatagtcgaagattagattcgatcgataacagttatttttttattacaataataaataaaaaatttatgataaaattatcattagaatctacatgaatctctaggcccttcagctgttcataaccatgcaaaaactccactaattagctcacatgaaagcatcaagatccacatgtagagaaataaacctagctttccacactgagattatataagaaaaattggaattatataaacttgtactattaactggaatcatatttaacaaaatcacacagttgcgaggccaacctgatgattggacagtagatacgtaatttgtacgcttaatctgaccccagagatgatggcctttggccactttggcccttacaaaagggaagtgtgacttgcctttccctctcctttttctttactctttaataggcttccattttatgctgccacctttctttgttctcacaagtgaggataagattcctgggccagtgaattatgaagctttgcatgaactataaatgatcctgtgcattggagaagaacgaattctttggcaatcttacaagcctagccttgaaagtaggcacatgaagtaaagacaccaaaaagggaaaaaaaaaaaggacctcttggtcccatatgtcaagagcatcatgacatcccattcagcatggcatatccctctagccatgctaccttttcccccatgcatgtcctactgatgattcaatcaaaaataagaaccagctagcatcatcaggtgaatagacatgagaggaatagccacctttttgcatgcattgtgagcaatgaatggatcaaataaatggaccattgatatctaccctggagaaaaatgaacaggctccatgcacaaagaattaccttatggagtgcataaagatccaagttttgagagaaagagctgcatgtttaggttgttttccctacaaaataatagagaagtggctgcatagatgaccattcccttgctaaaacttttggcacaagtagaaaagctctaaaacctcacattctcccaagataatgaagactggatcaggagatgctgcaagcttgccatgacaagttttcaaaaatataaggttctggacataaacattatggctcatagcattgacttgcatagcagaagctaagagacactaacaataattaaaacatgtggctactccattggtcttcatttttcttttaaatggttggtgcattttgaacttatacagaaatttaaatttggaaatcctttattaatcaaatgaatcatgaaaaagtctagtagctcctctgcctaatgtataacgaatttataataaaacaacaactaaattacaacttaatttaaatattggccacataaatgtatgtaaaatagtgggtaatatacaaagagaaatggtgagtttcagttgcctttttttttggtaaatgccaaaacagtatttgctgatcatcatatcaccgagagtagaatttattggatcaatgagaacttttctaatgcaacgtcaagaatccaaccctgccgacactaaaagatcaacagtcaagacaacacccttcaattattagtacttttattctaccaaaaaaaaatatatacttttagtataatttgtgtttttttaataatatatggccgtcccatccaactccactacgaacagaacgcatgttatgtgatgcttgtctcatgggtcactctccttttagggggtcattatcatggggatcccattaaactgttggtctaatttgtgccccaacaaagaaggcacaatgataaaatataagaaaaaggttgctccattcagcaatgcttgagaattaagatgcaaataggaaggaaaaaagatagcacttacatactgctccatactccttttgttcctagaggtggcattgttaggtcaatgtggaatccaggaggttggggtgcttggtgttatgtttgttttgtgcttgtcttcaaaaagtgtaagaagaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacctaacgccatcacggttttttgtttttatttttttttaatttgtcctcttcttccaaaggaggaacggtaggttgacctcgttaaaaaattaataatgaggaacgcactggcattgagttagagatataattcatgaacttcatcgaacctggctctggattcttacattttttccgttaggacagatataatggttgtatggtggtttcggtttttatcacaagaggaaggaatgaaaagcagtacttttggatgttatccgcagttgcgaagacaacataaaattgtcaagtgtcaagattaaagaaacttttagactatgatgagcatcacctcatgatgccactaaatcatagatgtacccattaaaaacttagattccattgcaaattttgtttaacctacaaaatcacatttaggaggaaaagctaaccaattaattgagataaagacatagaggacttgtgagaatttgtattttggtgctaaattaattctaggaggaagtaatatgtgaggatttgtattttggtgctaaattagttctaggaggaagtaatatgtaacgtattttataagaaaaaaaaatcaaccagtagatcactcattaacgtatattgcattcaaaatggaggggaaaatcatcaataatacacataaagtgttatgatctccatttttttcgataaaactatgaaacttattcaccgtcgactttattaagttatctctaaagttatttcaagcaaaacaggatttccaaatattttacaatttaatatcattaacgaaattcaatcattagcctctttaatttgagagtttgggatccacatttgccatagagtaatggtacatgactcctgttatgtgcatacatggcaagtggagattcttgtaacttgggagacttgttgccaaaacatgtagcttcaattaattatgtagctgtcaaattaataacgtagacctgatgaagtttttgtgtgccatatcaggcatcctgaagctttaaactcaaataaattgtgaattggatataaaaaggaaaaaagaaaaaagctggttcacaatatgagccaatctaataagaaaaggtgaatgaattaaaataatatatatatatatatgcaataatttatttggatagttcttagttttgctatttcttcttgagtttgtacctcaaccggagaaggccggttctccaggaacatacatgggccagtggatcaacagggcccattacggtcgtgccgatcactcatagacagcgactgcccaagaaccggccctctccattagaggtaggatcccagctcttcttccaatgtttgatgtggatttgagacatgactaaataatggattcaaactttcggttttaaagttagcatttcttgctcaatgcatcccttcatattggcaattgattctttcgtgggccaacctgattccccacccaattgtttaaaccaattgttgtgccctattgattcttctttaattaaagccctagggcagcttttacaagcaaaaagcttccaataaataaagcactagaaaatagcgggccccagggatctaaaaaagtggttcactcctgctacccaccagtaatctagagtcgaaggatgctttatggatcaaagtctcaaccaatgggctagcaccagccacagcagtagataatgtcccaaactttatacccttcagctgtttgtaaatccacttgttcaaatggttgcattgaaggagttcaattccacatggagcaaacctctaataaggattgagattatcttattataagaatgtcaaaggacacaaagattcaattagataagaagtgtgactaattcttggggccttgatgcacagaaaaggttcaccatcctttaggaggcctataaggaggcgccatacataaagtcaagttccattttctgtgctctcctaggcttgtgcagtacaaggaagattaagaatctgggccctgcgaggcatcagatttttcttgcatccaacagtcaacagtatgaagcaaaggactatgacaatgacagtggacacagactctcatcttttcttaaagaaaacgccatggcgtgaagggcatcagatcgtctgcctctgctcacttggctgaaaagatgaagtggggctatattaccttttcccacaagaactttttggaaggcttttgttcaactagctaccaaagtttttcaggttaccaacatgttctctttgttgatccaccattagctgtctcaccattgatatccaacttttcttcttatgttaggccattgtttcagagtacacaaatttacacacaagggagcagaatgtaagatagaaaaagctagagatacatgatagaagagttttatgaaacttcatacagatacagatagaagcattattctccacaaccaaagtgacagatcagaattagttgacctcgttgctgctatcttccttcccacctttgaggaatctggaaaaccagatggctgatgattttggatgccttgcaaggccattcttatagtcaacatatatcagcccaaacctcttggtgtatccttgtgcccactcaaagttatccaacaatgaccatgcaaaatatccacgaacatcagcaccatccctgtcccaaatacattagattagttattgttctgtgttttattgttcatttcctaccacaaatgcacaattttcatgaaacatttatatgaagaaacggctgtctaggtacaactgaggtcacaaggacatgcatatgcaacaaacatattatacagagaaaatgcaatgaacataggtccactggcaaataggccatcacacgactatggtaggtaggtcgaattaggagatgtgtacaacaacaacaacaacaactagtcgggcatttaagtatatgagggcacagataaggtgccaaacttgattcgaatgatttgcaaggtttgagattggatgaaaggttaccaggagacaccttggtcccaaaattcatggcaaatcatccaaattactattccaatgggctgcatcattgccataaaaccaagacaaaaaatgttgcaggacgtaggttaccagcagcagcagtagcacaataaatgattaggaagcaggtgcaacgacaaatttccaaagatattctaaagcagatgagctactcttaagtggaggactactgatgttctttcaatttacacaattcctttggagacttcagtcaacaatgtgatataaacattgtaaatgagataatacatatggcctttcatcattttgagcattttctgtcacctagtatatattacaaggatatgcagacaacagtaccatagcaatgcatagaaaaaatataatcatcttcataaattgtgatatgatgtaccatgatagcataaaaatatcaagacaatattaattagttaggctgcggttgaagggttttaattttaaaatcatgattttgtcccttctcttgagtcaaaatttctaatcctttaggagttgagatatccaaaaagacatgttgctcatcttaagggtaaatttttaaaagattcacataaaagtaaaagtttctaattccaggataatgggtttatgaattttcaaaatgcaatataaaaaaatgcatttttatgtcattactaataatctagaaaagcatgcaacatgacaaaatataaggttctgcaatgcactcagcaacgaatatacttctcatgaactccttgctgaaaattttgcctgttattacagatctcacactcataatgcttccatcaagaggcgtcagtttatccttctcacatattggtgatttgcaagagtttattttttatcttcctaccagaactaactgtcacataagtaaaatgatttaaaagttcagaatccaaagcacacatttatgtggtgctatcaatctgaaactagtacaggaagttaaagcatacatgtttagaaaaactacagttgtaatgtacctgattgcttgcgcaacagcagcgatgtaccccttaaaatatccaactctcttttggtcatttaaggcctcattcagtgctgctgtctcaatgtcttcatcatccatacctgcaggttatagacaagtagcccaatgaatacatatgtgaccataaaaagaattcctttttttaatattaactgcacacaacatttataacacttgaatcattattcagcatgtatttcaagcaaaataaattagatccctattgcaaatgattcatatcgccttaaaattttaaattttcacaagaatactagacttggattgtctgcagtcctatttgtgagtgcataatgaaatgatttccattaaaatcggagacatcttttacggcttggaagagtttggtgtcaatccctttcaataacgtctgaaatttgtaaatctatcaccaactttagaaaacatagggaaaaaatatccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatattttttcgctatatagttaagaactttacggatgccccaaggaactatgtaaagccactctgatgcagcctgccatgatagaaaattttccagttagtttgataatgtcagatgcattttgaatgtttggtttcattgtccagaaagctttcttagaggatgcttgtgcatgtgatgtagacatgcatgcacatgtgcatgctcccacaggcgcacacacagggaggaggggggggggtgtggggttgtgtggagagagagagattcttaccctatcaccaattgcctcacctgcttcccaattagctgtgcataatacaataaataatactggtcaaactgaagctttattgaaataaatgcaaaagttactgcgagactggcaactaataatttaatatagggatattcagaaaaaaaggtgatttgcaattaaagaaaaaatttataatgttgtagatgatctcatttcagagaattagtgatcaatctgatacacataagataacttggcaacatagtgtttcattgaagcataaatgaatgatttagagaataaagccataaaacaaggtgataaactattttaaactcacaaaatcatagaaaatagcatttcaggaactaatttatggatgtacataaggcagacgattgattcaattctaaaccttgtgatcattttagatgacttggattaaaataaaggcaagtgtgtggttgcaaaccatgcaagtaataatgaatctgccaagtgaggagaacatgcaattggtagcataatagcttaaatatgagtatcttcagataagaggtagcccatatgctactgagttcacaacactagttgataagtttgatcaattcactaacacagggacatgagcacaataaagcaacactatccttaatgaaccaaatagatagagcaagctgcagagagcgagatggaaccgaaaggagtaacatgatgtctgatcagggaaaatgcttatctttgggagaggatgcaagtaggtgctcaactaatgttatcaaagtttccaggtcaattgccaacatccgtttgtgtgcataaaaccgcaatgcagaaagaaagcatataggtgaattgggtgcacctgcatgtcctcatgtggaagatatcattgtccaacaataaaaggattcacatggcaaagtttgaaagatgtgttacttgagccatttaatttagattgtagaacttgatctcacaaggcaactgtcctgaactcaaacccaaccaagaaagagcctagaccactcagatgagtcaaccaggccttgtagcaaaaaattagatgctgatgctgcaaaactagtaagaatttagtggaattcaagatagttagtctgcttgatagcgtcttcaggaaatcaaactggagatccattcagttgctaaggatgaaacttctttgacattaagtgccatgttatttcctaaaaaacatcagcctcatgttctgcccacaaaatatataacccaaataataatgcctaatgaacttgtacattttcatttgctagccctttggatgtttcaatgtgagaaatatgaagtgatgaaatatattaacttatataaaagacatcaagccagaaagtgacaagcccggatagcttgcttctcttgctacaactggatgagaactgtaccattccattatttcttagagaaaccttcaacttcatgctgcaaataggaaacgatgattgaggttctttggagtttagagttgattattatcaggtttgtaggtgagtgcacattgaagaactgcctttttttttgttggcttgctgtgtcctgaggacaaatttgtcaaaccagtggaggtgggttgatgagaacaaggcatgatattttcatacatcaaacttcttgggcttacaaagtattctcaaaattctattgaaattctttcatcactttcgtatactgatccaacactactagatgaatctagcctaaataataaaacagatgtagagacataaacaggtatataaatatatcaatgtttcaatttcaaccacaaaacaaaaaagttaggaaggtaagcatataaatacctatcctgtccatctcttgtacttgataaaagtggatttcttttgtattttgtgtatgagcaataaaccttgttgtgtaatgattcaaacccacaaaatcaagcgaattccttagcaattctttatgtgcatctgagaattttggaagtttatctcctagtctctcatgcataactgcagggtagttcccgaagaaaattggatccaaaaaccttcaagaaaggaaattttcagatgttaaagaagcacaaacccttgttatattgataattacacacctcaatatttaaacaaggcacagaattcctgtacatataaaaccttgaatcatcaagattcaagataacagctaggtaaataaagtcttagaaatagaatgaacatttgtatctttttcaaaatgaatatgtatataaacatgagaagaaacataatacatctaagataagatcaaatctgatctgaaaacagaacaaagggataaaaaatgatcacaacacctacatactgctctggtcaatggctatctaaaaggtcttaggattgcatctttaataacttcaatataaaaataaggatatgttctaaagatatagggtgaaagcaatattgacaagcaggcatggtgctatgtttaatcaggaattagaattttcacagaataaaaactttataatgcagtctggtcaacaaacaacatgaagtcgaaactcttaaagggaccaagagatgaatccaggaataacttaaagaacttgaaaactcatggctattctatcatttctttatcgaatagcacacgcacgcccacatatttcttgtttttcgataagcatcgaaaaattggcttctgtttatgtgaacttatattctttggaggctgccatatctgacacttcaggagtcgaggacacttggatagttggcatgtcatgccaaaagtgtccagggaacactagttctgagaatggcagtccttaattcgatggcctcatgaatcgaaggtcatttaagacttctagttgcatttatagatggatcctgttgcgctttcttctacaagaagaccctccagtagagtttgagtcctagtaaattacctctagacagttgatcagattgcttactacaaacacaatcaggcacacataaaaacaagcacatacaatacatgaagaaaaaaagaatcctatgtggactaacatcatgaattaaaatcttccttaaattagaactaaagattctagagatgttatttccttattaaaagtaattcttgtcaaattatctgaaaacctcgatatataaaaatcttgaagtctggatgcctttggatgctcggagacaacacaacaacccatgacacttagtcagcaaagtttccctgcttctccctgaaccttcctacttatcatcccccttcaccaagctaacaagaattttgccaactagacagcaaaattttcaaatttgcatgtatcccaagaaattgattaattgcaatttatggaatactcttcgaggtaaggaaaaattgacaatgcttatgaggttgctggtgaaagaaccaatcttcttcagtggaagttataaagccaatgctttcacaatccacatagtcaatgttcaacatgtgtcaaacaccttaggtgagaatatgtagagagcaaaataatgctaccatgcttgccattttattgtttcttttgtgggatggagaatgagattgcttcacaatcttcatcatgacttcacaaggaaaatctggtggcatattactgagatattgtcatttgaatctgttggcaatatgctgttctagactccgaacaaaattagtaaaaaccttattttgttctgcatctgcaattaaatttttagcttggtttctaggtccttattgttaagctatgttacctgtaacttttgcccctgatattggattgtttaagtcacatgttatgtttgtctttcatgatatacaacaagtcacaaaaaatagctgttgaataagaaccacaactatcatatagaaaatggtttgttaggaggaaaactaggatttagatgtctctgtttctactcttcctttaatcacagaaacatgctctaatagtgattattctatgagctctctatttcctgagatgtgcagaaggcattaatacaaatacataaacaaactcttaccaagaagcacaagcagaaggagaagaagaagaagaagaaataaagtcaagactcaagagtatataccagccaagttgaaaatccagccgtctctctgcagctatcttatcttgcaatttatcagaaaatgcctctgcccattcacaatcgagaactaatccaacttggccaccttgagtagcctaaaataaagcaagtaaagctactaagccataatatgagtagaataacataaaagctggttcaagttcaaatgggatgtttctaatatttagtaaaccatcctaatttcccattgattatgcaatttaaattcaaattttgaagaattaaaaaacatggaatatttttcattcatttactaatatgaatgcagattttatgcagatagctaaacaatggatatgagtgtttaatgaccaataaagagatatttctacataatgactacaatactccataggaaacttaagccaaaccaaaccaatatatgcgagagaaaataaagtgcttaatgactaaaaggtgaaagtaagtcctccacaacgactgcaatgcaacataagaaacaagcaaaacctatatacataagataaaatatatcaaagaacatgccttaaatttcttcttgtacacagcagctgctgctgcatgggctaagagttggtgatgtgcagccaagtagggttcaaaagatgaattctcatatcttccaggagcaaataccccaacaccataaccattcacagctgtttgaagtggttcattgattgttatccagtgcttcactctatctccgaacttcgcaaaacaagtttctgcatatagtgcaaaatattccctggacattgtgcaaaatcaagtaacaaaaaatctttagaacacaaaatgcaatggaacaatatctggtcatattttgcgtcaaaaaatgttcttaaatttgtgcaagaaacatgtcacattttcaaaaggaaaaagaaagaaagaaacgtgctagtatgaattttaacaagatgctccataatagtcatgaaatgatacataaaacaaatgcatatatgcatacatagaatgccaacatgtccctatcatcaaatcacccgaggatctaaatgctgctggtgcagggatttgccagcatggcacgtactgtgcgatgcattgacatacaacatgcaccatcatgaagtgggcccactagaacagtggaattggcatgcatattatgttgtgggcacaagatttttccaggttttattttttttaaactttgacatttgaacttcgtcctagtccggttaagagttgctcacaaaattaaaacaatatttagctccacattttaaaaaactcctatgcagtacgatcaacatcttggcatatatgcatgctggagttctatgaaatatcttttttaaagtaaaatgacatcctaacaatgcattaatattaattaataataatccttgattaaaaacagacaattataaatcatataactctggatgggaaatgattggagaccatataatgatgaaggctgaagtgctctgctctaattagcaacaaatcagattaaaagacacttagacaccaaaaattgaaactttctcaccagatctttgggtctgagcaatgtttagatcaaggttcacaatctcagtactggaccccacatagctaccatcttggtataatgttggtacacccaatacaggagttgattcggcaataccggtatttggcatgccccctgtaccgcttcaaagtttggtacagcacactcggtaatgcactggtacagcataccatggtttagacgtcaaagtttgtgatgttttaagatctaagaagtttcctagcattgaaaacttgccagtttgatcagatccctaacatcgggaatctattcgagttggcaagttaaacttattttgatgaaacttgaaacgttgaccatttctatcaagctaaaacagagaatgcttcccttgtttaatgtagtatgctaagtaaatggcaataaaaaagaataaggatgcattttcttgaataatgttccttgtatgagctgttcccaaccagcaaacctctgactcccctaaggcaattaaatggtgaaaaaagaagtgaacctttctagcttagaattaggtcgtactaacctatctcgaaccagcatggctcagtgcaggtcagcagtgctccctatcgagcagcttgcatagtatgccaccccaacctagtgtcagatacctgaactagcccatcacttattggcatagtcagatgctggaacacttgatatcaactcttctaaaaagtattttgaatataggaaaagcaacttatcaataacaagcataagaggaaagaagttctaacgataaataacaagcataaaaatacgctatcaataggaaaaccaacttatcattataactcctcttataggatgttcaaggaaaatctatttttcaaactcatcatatgctaaggttgattgatcacatgaccataccatgcctcagtcaaattcttttctcaagggcttgcctatatgatggtagttgtttgtttgcagcaaatatagcaatttattctttggtctgaactagagaagtggaacccagatcagtgtcaccaaaagaatgtcgagttcaaaatttgtgcaggcagatacttagtctcttaccccaaatttatccagcatagttgtttcccaaaaagaatcatatcaaagtagcaaactagcaataaatagaacgctataaagcaacaaatgttcttcaatttatcttataatctagtttttggtcgacaatatagagcatttgtatataacaatattgaaccatgtaacaaggcagacacgtaaagagtgggccttggtgcaacaatttggttgcttcattatgacatgggtgtcacaggttcgaagcacagagacagcccctctacatgcaggggtaaggttgtgtacaactgaccctcttcagagcctgcaacagtgggagctttatgcaatggaatgccctttttagacacatagaataagaaaagtaaactaaaggcaaaccacacttatctctatctaaacttaatcatgagtaacaagcataaactcttaggtctttatgaaatatccagtcaaggagtatacaatttttgaacaaaaattgatccaaaaattacctctgtgacatgtaatactaaatcaggaatcacctaaccccaatgttgaagcacgataacatgtgcaactctcatcataattcagaatttcattccaagacttgacaaaggcatataagcaacatattaatgtatatattccctctatgtatgatgtaaatatgcattgtaaaggtactaccaaatgcaacacttgtctattcatcttaagataaagaatcaacagttagaagttgtattttaaaagcagaatttgctaataaacattttggtgttctgttctttttattttaaacatgtaatcagtatgaatagattaccacaaaatctgaagttttaatgaacaaaaaataaatttctatacaatagctatctataaggatggattatccaaatcaaatgaaaaggaaaaggaaagtgcacccaagatttctcgctagcaaaaaataaaggaacaggtcattgtcatgttatttgtcagagttatgatgaaagcatggaaaatgtagctaaaatttagatttcattgctggtacatgcaatcaactgctaacattcataacaatctaaattgccaaaaggagtttgagaatgtagcaggactaggaatacatatccccactctttagtatagttgttcattgtagcatattcagttacctaatgtgtacttttaaaagcacaggaaacacatgaacataattgcgacatgcaaccaagaaattctttccatgcctgtttcttagtgaatgcttaactgtagtcagaaagttcaggcaatctatttgaagcttatcactaactattcatgtattcaacagaaaatgcttaattatataaaacactgtaggcattttgtaatattatatatattattcaagaaattctcagcactttgataagtatggaaacttacacaatcttctcagatagccatcctcccatggactcatgaagattatatggaagatcccaatgatacagtgtcacataaggctgaacacctgcaatcagaacacgtaaatgtaggttttgctggatatatttgaaggcaccaagcatatggttaacaacctttctctagcaggaaatcaatgagattgttgtagtaagcaatcccatcctcattgatctttgttcctaatccatctgcaataatgataaaagtacataactaattccaccacagaccattatatcaccatctaaatgcatatatatcattcaaatgactacaaagatctagtaaaattgaacttaatgttgctctcaaaacagtattcctcatgcaacatatacatatacataatacatatatagatacagacacatatgtgtatgtatgcagacatacatatatcattatatgaatatatgcatgtatggagttacaatactttcagagagagactatgagagaagaatttcttgcaagaagtcgagcacaacatcatgaagatatgttgaaggagaaagaggcacctcaatttcttagggacttggaccatagatgttcctcatcacatgcaagtcatattgatctagctttcaaatttcaaaagtgcatttttagagcacctacttaaatgatgagatatgcatagaaatattacataagatcggataactcctgcaactattttcaatcatcctcgtccaatctttgtgataattttagaacacttaggccttgtttggtacagctttttgggaaaacaaaaaccactttttggccctgcaaaagtatttttggatggtatagcggtatttggtaaaaaaaatgcaaataatgttttaatatgtaatattacatcatactatactctactgtacaataccatgtaatattccttttcgtcattttgttatatcaaaagcactttatcaatttggttaccaaacacatgtcaaagttccacaacacttaaaaaatggtaaccaaatggcaaacgactttatgtaaaagctctacttctcacaagctaagccctaaaagctctactatcaacagcaattccaaacaggaccttattccttaatctacccgtcttcccgtcatatttttcaacttgttcccatgattccaaccattgtacctcttcatggtgtcctctagtctatgttggcatggctgcatcatttcaaccatatttgtaccatcttatctattatatatgtgattcccaaatcccaattatttctttatattcttatttttcaacttcccaagtcctagtatctctacatatttaccttaatcttctcattaacaccctcatcttatgagctaagctaccctaatcggtttaatatatgttaaccaaacttcattatgaaaatttccattaagcgaatacatacagcactgaaaggaaataacaaaggaaacacatctccgcatcaccaaaacagctctaagttttcaacaaaagtggggaaggaaagccttttgtctctctccaccctgtatgatagatttaagatttaaaaatagctttatggcaaatcatttggttattgattgtaatttggcttattttattcaattctggttaaagctgcatttcagtattccaattctaactcattggacaattaatcatgcaattcattcaaaaatttactattctcaatacactgcaactgccataatggaacttctaatttaaacccatattgtttaaaagatctacatactcaattagcatttgaggctttgagcacttgcttaccttgccaattaacattacatcaccaataaaatgggagtcttccaaggttccaggctttggtattataatgcttagcaatcatgaagataagaacatctagatattctagtttcatttaaacagaacatggtgtataatcaaagaagatggtgaaagacaattttttatcttgtgatcagtaaattaaaaattggaaagctcagtgaaaataatatatctaatatatttagatatacaaaatgtcataaatgtctaagcatgatcattaataccatatcaattacattatttaagataagggatagaatagccaaattatttgcatatatgacagtatatcacggtattctttcaattttcagcagactaattatcactaatacatcatccaatcattcatatgtccatccatttttcttttcagctatttttaatatatttttcttttctttcttcttctttgttttgcttacagtttctttggaaagcatagatttgatataaaagctaaattaaccaaccaaatgcaataattgtaaccaattggtgtcaacatacttataggatacaagcactaaaacaagctacttccaccacatgtcacaaaccagccttagatcttttgtgctttaaaataggaaaaaaaaaacacaattttcaaagtatgtaaaccttcagtttgacctaggtgcgactgggtaaagagcctatatatggaaataaacctctcaaaaagtacagtatttggaaaagtaataaactatcaaaaagtacaacatgccaactatgaagctgcaaatatgatatatagtgttttagataatgattacaagatatcatagtgtaccggggaatatacgaggccaagatatggaaaaacgataagctccaaaacctaggttggcaatgagttccacatcttcctgcatttcaataaatgaagtatcatggaattaaaacaatgttacaaccaagttcgagatgataaaggaatagagaaatgaaaacacatttgcaatgactgctaatggtataaacacttggattcacaaaaggctaaaagactttggtcatacattgtccaagatggaaatgggatatcaaatgatgctacatgccaatatttggcaactgggacttgagaacttatttagcttatgcttcagcatgttgataaatctcgtactgagacattttcaagtatttcttcaataagattgtcaaaatgactagatagtacacattaacagttctatgcatgcatacagattatttaatagctaagcagttaatgcatgataccatatgttaaaaataagcatttataaaataataactaaaattttgaactattgtatgtaatgtctcacatagttgaatttgtttgccaaccaataaacgcacaaccccattaaaaagtggagaaaaagtggtggtcctggtggtagcagaagaagcaagacaggcaaaaaaaaaaaaacttgaaatggctgaaaataaagaacaatcttatatgtgaataggtattttgaataacaaagagaaattctccaccttggttaggatttccaagaaaccaaattgtttagtttactctgtcggcagtaaccctaaaatggtagctcaattgataagaaacccaactgaaaccggggttccaattgttcaaaattattttcctaatacaaaatagaattgttctttcttttccatttcctcttttaatgtcattgatgaccatctccagcttttgatttaactatcaattccatacttgcttcagcatatagttaataaggtatgtgaaacaaaaaaaattagtcaaagagaacaactcaaagcaatttgatgcagtttaggattagggaaatgtacaatttgagaatataatttgaatatttttatttttagatctaatgacaaccataactaatctagaccataacttaaaatacccatatgacaaacggttaaggattccaatgccaaacaaatctgttgatatgttagaggcaacaaatgggcctatttacaccgaattatcatggcctgaatgtatagtgtggagataaagaatgtaaaaatgatcctcttttatttttttcgttatcagtctagctcaagcgttaagttccatttttttaaaaaaaacactttagattaaatcaagatgtttgaggattgaagtcattatggccagcacatggaaggaaaggccattcccaagagaatgaagaatatttaagaaaattccagtcacgttctcagttctccctttctctgttgcacattgaattccatgtctacagtcagtctttccaggctcaaggatttgctacaaatgtgtattctgtgaaatatatctcttctttctgttttgtcgagacatggtctaaaaatcagatcaatgcttcttgtaaatccaccaccacagttttgaagttcatgggtgaaaaaacatcacaacattcatctgcctcagttagtattacaacctcgaatgtccaaaatggagcatcataatgttcgacctgatgacaactgtaccaatatgagaaggtcccacagagtgaagaatgattgaagtcatcaaccaagctgtcaaacatttaaatgggtaattttccagcttggagaagtaggtggaagatctcatggtgcacttcaaggaattcatggctcccaccagggaaaaggatgcacgagtagcagatgaagtccataaaccagaaagatttgtcatctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcttaggctccaatatcacattttataaagattaccacaacatgatagagtgtcatttttataatttgaacattttctacttaactggagttcaataaaattcggtgctaaagaactagcaaaatcagaagtaaaacctcaaaaagacactgaactttccatccttcaagcaaggtaacatctgtcctactaatactaagagatttttctgaacagaacaaataaaccatcactcctttttgaagattaccacttcagtaaaacataagaatcatcgatcatagtcacaaaaaactaaaataaaatcatcagttgtactaggagatatggttttaagtcccgacagtatggggcgtgtcactgctctcccgtcttatttccatgagaaaatgggatgggtataggggacgggactctgaaatccatcggagaaaaaaaagaacgaggacaggaatagaggaatgaaagaagaagaaaaggaaagaatacataaaaggaaaataagaggggaaggaagaagaaaaagaaagaaaggaagaaaacaataaacaaatgaaagagaaacaacaagaaaaggaaagaagaaaaagttaaaagggataagaaaagaaagaaagtaaggaggaaagaaggaacaagggaaaaaagaacaaggaggaaagaaaggaagggaaaagaaatagaaataaacgaaagaatggagaaaggaaggaaaaaaaaaaagaaagcgttaaagagatggagggtacctatgggacaggatagaatagcggggcatcctattccatagaaaaaccaagacagcctaatctcacgggacttataatcttgatacaagatataactaatgaagaaaacttttctgaatggacctgcacgagaacattcttattctaacttttactccacagtgctctctcaaagatatcccatctaaacataggcaaatttgtaatatttaagcttcgctcgattttattcctattttcgtttttgcatcctctcttctcaaactcgccaaaagagttattctactagataagccagctttctttctttatacggaatcaacttatagatattagtatttaagttaaaaattattaactccaacatactcattggggaacccaaaagatcacaagtgagagagagagtcaacattaaattccagcatttccattttttcaaagaaaggtatcagctttaaaggatttttctataaatgtgtccgactgtccgctgatcatcggcacagagacctccgcaatcagataaaaaagcaatctccaaaaaagagagcagaaccagtttttccgatcaaatatgataaaaagccatgaccctctctgaaaacctataagaattccacttaaatgcgccaagaaaaatcaaaatgagcagcggatgtggatggagttctcagcgctggtcttcatctatacaaggattgaagctgtattggaagctctaaatcccagaacgagcaccgggtattgtcaagcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaatcatttaagatgcatccagagtttcgcttcaagaatgaaaatttccacgaaacaaaacaggaaacagatcggaaagagtcatcgacagagaagtaagagtagaagaggccattctcctcctctgtttcacctggtaagccgaagtggcgactccgaagacaaagccctccgggaaatcgctccgcgaaacctcttccggaactccatcgcatataccaatccttgcggccattggagagcaaagtagcagagaaaaaccagacggtacagcgcgatcctcctcccgccgcgggtagttggacccggagatcttggacgctcgtcgccacgaggccactcttaaatagacggagcggacgagtgtgaggccaatgtgaggccgctgcgcggatgccaattcgatcattattcattggttagtaatgaacggtttcggtttcggtttcggtttcggctttggtttcggatgttgctcgttaggtgtcccgtatttctgccgggaccaccaatatttgtgacgcgtgtatgacaggtggattgacaggtagattggtccgtttctggagtgcgcttgtcgagttctccgaagttttacttctgcggcagaactgacgcgatggctgacacaaggaccccaaggtggactggttggtaaggaatctgccggtactttaccaaataaaaaaatggaaatctgccggttagctgcctttgtttatctttccctctaaaatatatatatattttttgtttagagatcaagcatggtgccaaaaatacgaggttcattatcatggaaactaattaaacctcctactattaaaatttattatattatcaaatcatattttaaaaataagtggataagaaaaaaaattataccttatatattgcaagaggccaatattaatgatattgatattaataattaaaatttctatattgagatttaatttgtacagaattcttcatttgtaatacaaacatcgatattaatgataaatatttttatttaatattatattattaaaaaaaattaccaaaaatataataaaattttttaaatattaatattttttaattattataatttattatattattatattgtattttattaatgattaaaaattacaaaactagtattagaaagcttgatgcatcaaagatcataacgtattggaattcaattgacatcaatatcatgcaataaaatatatattatattatttgatatataattaaaaaatatttgatggacctcttttcttagatcatacaagatagctaacctaacctactattttttatcactatagcatcaattggatcccgtaactttcaacaaataaagtgaataatatattggtgaaaatgatatgagattgttagttgtccattacagttggtcttggaattgaaccaaattcttttatatcatataaaaaaatttatgatctgaccaacattgattatataggatatgatcctatttttaacaatacaatccatttaagtgggttctactctttcttcataactcacaaacattcgtgacccaagatcttctaagatgcatggcttgcactataaaataccgtgcaatactcgatggccaccataaagagatagatggctatcaaaaaagttgcaccatggcacataaggttattttgtttgatacgcatccatttttttgatgatagccactgggtattgcgcaatactcagcggtgcaacatatgaaccgtagaggattgggcccaagagtcgcatagagttcatgggtcccggggattaaatgcatcctatgtctaccacctattaatagtacttttttttaccaaaaaaaaaaccattattacttttcccaacattatcaacatttcacttaaagataagaagcaatgttggtattgaaagtgatcaatgaactaccaaatcatgactctatttctgcatttcaggagaggaaatgagaggattagatgttcattaagtccacccaactttgctcctagacatgcaatagatgattgacatgctaatttagcgttatatataggttacacaacatggtgtgtttgtaggctttacctatgaaaggtgcatacaatgttgatttgaagcatacatattttgggatcatggtgtttgtgggggctttacctatcaaagctacatcccatgttgattttaagcatacatggtttggcattatatgttacacatcacagtgtttgtgtaaactttttacctatcaaagctgaatgctatgttaattttaagcatgcgtattttgtcattatatgttagtgtacactttacatatcaaagctacctactctgttgattgtatgcatacttacaaacttaacctgtttctaattttattgagataataaaaaattaaaccttatcaactagtatgcattatatgttacatatcatggtgtttgtgtgagctttttacccatcaaagctgcatgccatgttgactttaagcttgtatattttgccattatatgttagtgtgcgctttactataaagctacctactatgttgactctatgcatacttacaaactcgatctttttttatttttatgaagaaaataaaaaaaataagtatgtggttagcattaattttaaaagttaaccttattagctagtgcgcatgttatgttatatatcgtagtgtttgtgtgatctttttacccatcaaagcagcatgccatattgattttaagcttgcatattttgtcattatatgttagtatgcactttacatatcaaagttaactattatgtggattttatgcatactccttagctcaacttttttctatttttattaaaaaaatttaaaaaagtaagtatgtgattagcattgattttagaagtcaaccttatcagcaagtatgcaatgatttgatttttggatggttcatctatgacattatagtaccaagtcttccactttttctctccttcaagaattacttggctagttaaagaaactacaattttattgaccaaaagagaaactagaattttcaaatattgcctgaaagttaaaaataataaaaactattatacttgtgtataaggttcatcgagttggtattgaaaatcatatctgcagtgattggttcggtgtagtatagatccatattgtgtcattccaggataaatcataaaaagaagagccaaaagaaaaaaaggaagagggagaagaagagagatgaaaagaaagataggagtgaagagggagaggatggaaggagagagagagaggggttaatttgagccttgtaaaggaacttcaagaaactccgaatttgacaagagagagagagaggggcgaaagaggtcatgagggaggggggagagagagagaaattcatgcactacaaaatattcatgtattagagatgactattagcgacggcaaaaaaaccgtcactaatagcactattcaccgacaatatattacgataaaaaatctttcgatcgttaaaaattgataaattattagcaacagcttaattggttaatagtgattgaaaaaccgtcgctaataaactattgacgacggctttagcaacagagggcatgctgtcactaataaattaataagtttttaaaaatttgactgtaatcttagtagcgatgaataattttatgagtgatggtgttttgctgttgttaataatatcagcgacggtaattttaccagcactaatactacccctatttcacccctcatccaatttctgacttttcactttttctcttcccccctctttttcctgcctccggtccccccgtcacccctctctttaccacgtctctggtccccctctttctcccattgtcgaatcccaccaccccgagcctccgaccgtcggatctcgttttctcgagcccccgatcgttcgatcccatctttcagagcccccaaccacctcccacctcttcgagccctcgaccgttggatcccgccttctagagcctctggccacctcctgcctctctgagccctcgatcgagagcccctggcctcccgcctccccaatcccccgaccacttccctgagcccccggccaccttctgcctccccaagcccctggtcacctcccgcctccctgagcccttgatcgagagcccttgaccacgagcccccgaccgcctcttgcctctccaagccctcgactgcctcttgcctcttcgatccctcgaccgcctctccaagcccccgatcgagatctcccaaccttctcccacctcttcgagccctcgatcgagagcccccgaccttctcctgcctctctgagcccccgatcgcctcctcgagcccccagcccacctccttctgactgccttcgatccccttctttcccctgctatcagatctagcttcccatagccgtcgaccacctcccctctgccacctcctcgagcccccagctcgcctccctcatttttcccccgcgccttcctctttcccccttcttcttctcctaccgtgcagtgtcgtctcctgctgcacagcaccacctccatgctgcatcgccgcctccataccgcagtgccatctttatgggttaggtgagtactagcaacggcgacatagcagtcaccaaatatcattgttttaattttttaaatattttttaattaatatttataagatttagttaaattagatttaatatttaaattaaattaataatatttaattaaatttagttaaattagttttaaattaataatatttaattaatttaaattaataatattattaattttaatattatttttgaaaggtggaaccactccgggaagctctccagcgagcctggaccaggacatggtttgggcctaattttttttaaaagcatcgggcttaagcccgctccgaagctcgaaaaaaattttcaggctgggctcgaataggggtgggaggctcggggaggctatgataattgcctgtgcgagatgcacctaaagagtctaaagagagatcgatagaggtgatgcatttctgttcttgttgttgtagttacagagcaagcttggatagtctgttacatcgtagacaaccatttgcagccatctcatagttaaaagtgcaaagaaacttgcaatgccttattgttcaatggcagatctgagtcttcttcttttcctctttttcttatttattttattggtctctgatttaagtactatttttaagtttttattttatttttaaaaaaaattttcactccttgtttgcagccttcttactttgcagccacctcatggttcaaacacgtctcaatgggttcgggctgggctcgggcctgggcctgagcatgattcgggcctgattttttctaaaatcattggacctaagcccgcctcaaagcttgaaaaaaaaatttggacggggctcaaggaggtgccggagactcgaggaagctatgatgactgcctatatgagatgcacctaaagagtctagagagagatcgatggagatgatatatttctattcttattgttgtagttgcatgacaagcttggatagtctattacatcacggacaaccgcttgcagccaccttatagttaaaggtgcagaggaacttgcaatgccttattttccaatagcagatttgagcctttttcttttcctctttctcttgtttattttgttggtctctaatttaagtactatttttaagtttttattttattttttaaaaaaattttcaatggattcgggtcaagcttgcatctcctagagtcatgatactttatctgaagcatttgaaagatgtgattttaaattattgtaggtaaactactttcaagttaacatgatgaatacaagtgtaacatacctctggaggtggcaagatcggacatcaactacagcaagttgatttctaaccatgattccaaactcttttgcatacttatcatgaaaaaacttgtaatatttggactcgagatgtacacttgaaaggtaggatcaagtcaagaaacaaaaatgattcaaacctctaggatattgtgctctctatcttgagggcgttcgcatgtaaaggtcaatattttagttacttgtcgctcgtttagctgagctcattgtcacaaccatcacagtaggtaagttaagtagttgagctcgttgtcgctcattcagctttaaatttttatatttagaagcttcacataattaggtttaagtcagaagaaggagatatagaggtcaaaatcaatcttcctatttgatggatgggatagaggtatagatatatccgtattattaaatggacatataggaacaatccattcgaaaaatgaaagaatatattaaaatatactcctccatttcagtttagacttgagatagaagggatgggtacaagggggtcaaaatttaatttaatcatccgatggatggctcggaaggtaccaaatatctgaaggataccaaacatccgatttatgctcctccacttacgatgaacttttggatctttgactcattttaaatacttgtcttgcattgccaatcatctgaagggtaccaaatatccgaagggtaccaaacatctaaatactcaaattaacttttatacctctatattcttatagttaccttactatttttcatgatgatgatccaaactaaatggatattgaagggattgactctatagatttctatgatctctttttttttctatccatatgatgtcttaaagctaacaaatgtcgaagattagattttatgaacatatatacttgactttgttcaactttatttatatatactcgattagattttacgaacatatattacttctttaacgttatccttgatctgcggcagatggcttttcgaggccagagtcgtcccagttagagttgtcaaaatgggccggcccaacccagccctagcccatgtgggttgtgattatgggggccaggctgggcttgacccacttgttaaaatgggttgtaaaaatatagtccagccctagtccacatgggctgtgggtttgggccagaccagcccacttgttttttcttttttttcttttctagggcatggttcaagtcatcggggatgaaggcaatgtcgaggaggatgatgtcggggttgatagggaggttaacgggctcccactcaaaaagggcagtctcgccaacctcgccgacggcagctgggggccgatgaggggggccagcgtgagggggatggaggtggtctgggctgtgaaaaggacgggctcatccgacctcatttgcaccggctgggggccgatgaggggcctagcatgagggggatggaggtggtctgggcggtgaatagggccggctcatcggacctcgtcgatggtggctgggggccgatgaggggggctagcgcgagggggacaaaggtggtctgggctgtgaactggcgatgagtcttgaaagtaggggaggggagaaaggcatgggggaggagacggtggctgcaccatttcaaattggactaggaggaggaggaggaggaagacaaaagggaggatttgagaaagaggaggtttgaatcggtgaggtgaagccgaaggagaagccgagaagaaaagagaaaaaaaagtgggttggcccacaggctgacccagccttaacccgattcagcccatgggctatgggggtagggccaaaaagctcacttgcaaatatgggccagaatatctcagctcagctcggctcatttttagggctacatgggttggcccattggcgctagcccattttgatagctctagtcacaatcgaggagagagctctcaagctgccaactcgcattcttctgcactatacgtattacgcagcaaattctgatactttaaatatttttttaatattattttattctttattatctaatataatattttttatattcggatgatgtggagtcaccagtgaccccacagtcacacaaagccgcatccgactctcagagtcagatgcatggtagaggatctgtccggctcgcggcaccttcaactcgatcggaggataaacagctcgtccacattcagagccgcacataagtactatatatcttcactgaatatatttaattttagtcactttaaagtctaacatttattgttcaaaataaattttgcagcgcatttacagagcctggggtgcctcgtatggttaccaatatcatccgacgattgatgccagagctagtgaatgagttctccagttagccattgggggctcgtgatgcagccttagagatattcctgataaatcaaaaatatttaatttttaaattcatggtaggtttgtattctatttattaatatacagttgcttctgcttacagaggtactatcgattcaagactcctcaagatgaggaagctgaccgtcggaccttcaaggaggtggccacgtagaggtttcgggatggactgtacaacctttaatagtctgctatagaatacttcagttttgagttaccatcggactgaaaatcttacacagatcattggatgcagacggatatatgggaggccttttgcgatcagtaaagtactgaggagtactctggtaggtagcaaagggcacagcagaatcggtccatccagtagcatccaattctgcatactggcggctccattggcatacatgttatggtcgatagattgataaaaattctatccttaaattaattttatattgaattaatcatatatatatattaattaatttaattttattatttatttattgtagacactgtaattgaatcgtgtaccaggacagctacagatatgggaggccacacatcagtttaaaagaattgatgattacttagatcctcattctcgacagatcgtgataacaacttaaaatattatttattaagtttttatatatactgatatatctagactaatgaatatctaaactatatagatagattatacagagtatctcgtattactgcacggcaaggatccgtcctctcagtccttctttgacctcgagggatggctcggggccaccggaggggtgagtaggagttggtccttctttgacctcgagggatggctcagggccaccggaggggtgagtaggagttggatcataggattcgaccatagctgagaccctccatcaactcgaggatcttcatcgacgtcctcctctcagagctcaatgatccagacgtgggttgacgcacatgatggcagtagcgacaaaatcatcgtcgctaataattttttaataatttaattaagaaaaaaaattaaaattattaatgataaatttttgtcgctaataccgtcgctaattatctttattagcgactgtatttttaccgtcgctaataatgataattatcgacgaggttatttctgtcggatttttagcaacggcaaatcgactattagcgatagtaattagccatcgctaatagtcttttttcttatagtgatttcatcatggatgagcttttagagctccgatcctgtgatgctaaccttacacgggagataaagaaagagataagaagagaaagagagagagacttacaaggttagggacctcgtcgtcatcgtcatcaacttaacgagaacaaggattagggtcttgaaaccaagcaaagctaagaggaaataattcaaatatagaaagagtggagacaatacataataaatagagagcatgaaccattctaataactaactagtctgattttggtacactccgaattggccagtttgacgtaattcgactaaccttgcttatgtatgcaagaaaaaactacttaccagctgcaaatgcaaatttttaaactatgtagaaatgatatatgaatattataaaataatgaattgttaaaaaatttatgagctagatatataaaattttgaaattgtttgttgtgacaattaatgagcattgctttggttacaatcaaatagaaatctctattgataatttggttcatcaattacaacaatgacctcataagtaacattccaataaaagaatactaagaaaaagtttcatgccttatatgatttcagcatttatttcttgctcttctaacaacacttaccctcctatgcaataaccatagaatatgtgccatatatgccatcatcatgtttgttttagcattgatattcagaaaccatgacatgcctatttatgacagcataaggaataggaagatgcatttaagatgaaggaagagcaaactttaatcgtcttataagatatataacgaataaattagtacatatattattttttatttatttgtcgaggtaaatatatacatcacattttctattaagaagctatgcagaatagtaatattttattttgaaattatttaaggttctttagaaccttcatctaataattaaattaagacctgcactctttgattgtcacattattattgctttattatagtacgactgcttaactggctacaaacaaaatctttctctaggttcaatagtttcactatttaactaccaagaaattagctttctttaaaaaaaaaattgggtgaaaaaattagcttgtctcccttatgtatctataattttgcatatcatccttaaaatagctaaaatcttttatgctcgtgggatgtgaacatgtagagaataatttatgagtctgaatatacaaaaaataattatttgagttagtgccaataagattcactattactttttcctgtactacaaaacctagggatcaacaatgattgcacccattcatttttttttatttttatatttttaagtaattattatcattttttgtggtcaattaattgattcaaaatcatgctctctccttatttttctataaactaagaatatctccatgccgatagaccattccttaaatatgaattagaaaaatctttataccgccgtagaaaagatatgcttccaattaagaaactcttatcatgaatgggcataatgaaattcaaaattttatccaaattaatgctgtaggatttgtaattgatatcaacatatttagtttatcttcatatcgtatcaacatagacaaaatgctaataaatgtagttatgattggtggatagaatgttgattgtatgtatttgatgtgtataatattgaaattcatattttagataaattactatattccaaaaagatgcaaaaaatatctacgtacatacacaaacaaatatatatatatatatatatatatatatatatgtgtgtgtacatactattcatatatacatacatgcatgcatacatacatatacatatacatatatgtacatacatacatacatacgtatgtgtgtatgtatgtaagtggtatttttttttctccttttattcatcaaacctctctctttatacccgttttcatgtcaataaatatacaaatatttttaaaaaaattattctttatttttgttattctttagtttctctctctctcttcttttttatttttttgcatttttcaaacttcaacaaactgttcctcaaatctgaacttttgactatagccttatattagtacaaagaaaaaaaatataggcagttaatatataggtacgatcacaataatccaaataaagtcgattctgatcggaccaaggctctgaccatacaatactatattaagatggctttttctaatcacaaatattggtatatctcatgaaaaagattaaaaagaaaataaaaatttggtagatgattggaattgtatggatgccagggcgctggcaatacaacttgtttgataatttttaaaccacctatccatctatgatgttttaatgccggcttctacaacctccaccaatggtagttcttaaagcttggaagtttcaatgatcctcctcaagggctaatcaaggtgggaaacgtacacacgcttcattccacctcatcactcatatattaatcatggacttgctcgattgcaagttcattcattatgcttaacttgaaattatacaattttaagtagtcgcacccatgttttcacccttttttatggctctacccacgtattttccggatcctgcgatgcgaaagtatattccctcgcatgagtccacggctcaccatgttaactccatctccgggtttccagaccgcaccagaataaccggaaccgaaagttccacctagcgtccgcatacaacttgtatgcgctctctccagagtccgtttgcttttcccacgccgtgccgcttagacggtagatgtggcatcccgcataacaatttatacgaaaccacctggctgcaatcattactcgccttccccgacaattataagattcccgagttggaaaggggaaaggagagagagagacgagccatggcgacttccaccgtcccgaggctcctctccctcctcctcctcctgctctcggccctttccctttccgtggggtcgtcctccatggagacggtggggcagagggagtgcgattacttcatgctgtgcctccaatggcctggcaccatctgcaagagtacccaccattgctgctcctccaatggctgctgccggtactcctttctgtctccgatcccctcccttttcttctggcgttcttttgattctcttggtgctttttgttggatctaattcggtccgatttggaattctatctggaattctaatgaatccaagaattgaggttctttggtttaagcaggattaggtttagttttgtttgatgtggttcagtaggaaatttcttttgtattggaataaattgaatcttggacggtcgatgtggttgcttcgatcctttgtcgagatcatttgatttgctataatggggtttaaattgttaatcatgcgatttctgaaatgtcgtaatccgggttctttgctcccgattgtctgatttttgaaggatttatatgcagtttgggtgcttaattcgttcttgacatgaagctttatgatggcctttttcttcattttttttttaaaaaaaaagatattgcaatggatactcattcttgtttttattttcttgtaatttcttgatatttgtagattacttgtttttcttatatgttctatttcgtgtaatttggaggaaggaggggaagacaggaggtgacaaccatggaggtttttaagaaaaaaatggaattaaaaaaaaaaaattgcaacaacaatagaattatgcttcgggtttgtttggttggggtatgtcagattacgaggtaatctgatgatttctgaaaattatttatccggaaaaattattgtggaaaataaaatttaccacatttggatggtggaatactagctctgaaaaatggcattggaaaaagattgtgttttattggaggtaatcttatatcgaaatattgtcaaattttcaataatacctgtaaatggataattcaaggaatagcatttttctcaatccatttgtgggacatgtatggcccatttacattcaatattggctattttgaatattgaaatatatttacatgagctatatatatagttacatatacactgtttaatttaatttttttataaattaattatacatatattagagaatatattgtattataaataaattttagtatgctttattataaataaatttcagtatgctttgtaatataaataaatatattaattatcaataaatcctatgttagaattattgataattaataattatttgttaattatttactaataattaatatttatgtataaatatattaatatgttaaatatattattatttatataattattaatcaatatttaatgtatttataatattaatataatcaatattaattaaatcatctaattaatataatgttaatataatataagggtatttctatcagggaatgatattttcagatgacctccactcgatgattcagcgagagaaaacaaataccacccttagggtggtatttgttttaccttctctagcaagataatagatatgggatccatgatttattttactctctctctctcatctacctttcataccaaacatggtaattcaatatgggatttattttcccataatagattacccccaaccaaaggtaccccaagtagaggaataattagcgaataaggattcataaagctattgttttatagttggcacaaggctcgatgtttatttatgatcatggttccttttcttctcgttctatgttatgccttaaccctgacccatgttggagtcaaacatcggactttatgaactgaattattttttttttaaatttccccttttccactaattgaataagtttttcccttttcccccacttctcctacctgaatgacttgtttgatagttgattggttcactgttatggcctttcttttttcttttatttaattatttggtttgttattgtttgcaataaattaagtttgaattgctttatatggttttcttaagattgtgttaagaaggccaatctatagttctcttcttactctgtggtttatatgcagtcttgtggttggtttattctttatctggaatttttaccctgtttttttaatgcttattctgttggagtagatattgttatttttgtatgtgtggctcttccctaattttgtttcattagattacccttgatcagcggcttacattcattataggtaaatgaggaattgttgtcacgactattttctaattaattttgtatttacctttttgccctcgacttattattgtttgttcttcttgtttaaacctccttttatgttctttctcaacttattattgtttgttcttcttgtttaaacctccttttatgttctttctttttatttcatcaattgtaaggatgcatcttgtttatggataaattacttatcctgcagtgctgcgattttgtaccttttacttcttgcaaattcattgttgttgtgattttaaatattacttgtgttatgaaggcgatatgcccggatcttatcttcttagtgcttttgcagatcacaacctctgacacactttacaattcgtaagtgctatgctcttgagtggtattttaatttttttttgcgcagttgagaaatttgtgttatgtgaccatgctacgtttgtgatatcattatatgttgtgaatcttcattcttgtcattatatgttgtgacaaatgaaatccatgttattcatgtataatttatcggaaatcatatcacaaagtttctcccaactgctgattatttcaagagaattagtgggataaagttcaagagtttgaggagtggcagcaacatgctgatttatagcatttatcaggggggaaaattcatgtgtgatctatcgcattgtacctccatccgagcgatatgaacaagaactgctagtctgttagtctcttccttgtcaaagacatattggggttgcatatggatttctgaaaacatgctttattttttgttaaccatgcaattcttcagatcacttatgaatgttcatttcaagtttcaaaataatatttgtacttatagctagcaaaaagatttgaatatgaatgtaaatatccgctcttgaatatctaccaggaatcattctatgaattgaattctttaactgaattgaacattgctggattctcctttcatgcttgttagagaactcctaacctgattaggagttgttccaatttactggaccgccatatttccctcatcttggaccaggtccccatttgtttacaaggcaggtttcctagtcaaagtcagaatcattggagttgttgaataaacagagaaggagaaaacctgcctctttatctcttatttctttacccgttttcctttatttcttttctttcatctggcttgatgttattgtcttttgcactacaagacaagtaaacaacaaaaaatgtagcctatgtgtggtgttcatcatattgacatgttcaatctcaacaagcttgatattttttttttaaagttcttatgaattgcttgaatgtgttccacaaaattattaaaacaaactcatctgccattggatttaattgagaaatgaatgggaacattttgcttctctagccagaaaaatacagtctgctgctgagtaggtacaaagaaattagacttgtaacaaggagctgagggcaggtgtcgtcggaagtatataacttggaacctagtaggatgaggatgacacttcaagttcacctaaattgaaaaagaaatcatattgttctaatctctaaattatggagatagcatcttagaaatatgagacaatttgaaccatagtctgctgtaccgccccaaaccatccggtacaaagcgcactgtaccatatcgatatgccgtattgcttcgtaccgacactactgtaccatattgaaccatgtaccgacactacgacagaattttatgagtatagggtctgggaccgagatggcgaaccttgatttgaaccatttatctaatataatcaatccttttttcaaaaaaaaaaacagatgtacaataggaaaaaaggggaaaaaccttctttaatatcccacactcctattccatcctgtgctcagacgctgatattatttttttgatcataaaaactaaatcagaagttccatttagatttttgtggggcttgaaatgggtggtctcatgccttggatggtatgtgcatctaaaataggcaacagaattaggagacatgaacttaccaattttcttggctctgcatagaaaaagttctctctttcttaatgtcctgatggaacccaaagatgttcagagaagtgaaccccatctaaacttatgttctaacacagatgatcattacattgttacttttgattaataaagttttagtgtcttgatactctggacttaatactccattgtctaccttttataacagatggtctctggccaaattacgatgatggaagctggccagcgtgctgcagtcactctgattttgatataaaaaaggtgcagaaatcactgtttcacagcaatatatgtacaatcttaatatcttttcccttgttgacaaattaaatcaaataagtttctttctgactttttggtgtttgagtatatctgcatgcaggtttcatctttagtaccagaacttgagaagtattggccatccttgtactgcagctctccctctctttgctttggtggaaaaggactattttgggcacatgaggtagcaacaaatttccaaattacttccaaatatattcactacaatacatataacttacaaacttctgttgttttggtgcatgtgttgattggtttggacctggacagtggggtaacatctcttcttaacttatacggtggagtagaatactatcttttaaaataaattttgcattattttgtttagaagaaatcagtaaagttcctggaatattttgtcatttataagttcatgaaaatataactaaattcagagggttttgatatcctttcctatttcttacaaggtttcaaatgctggcctcacataccatgctgagacagtgctgacacctagcatgggttagcatggcaccaattcattcattaatcaaaaagagcactgtattctttttaattaagttttcagttcagcatggtgccacaatatgtccagtgtggctagcatatcctccagcactggcactaaaatctttgatttcttatccaccaaaaaatataaaattgtaatcacaatatataattaactactcattagaaaaagaaaagaaaggaaacgatgtgtagaaaatgaaagaaatctaccttcgatggtacatttgaaacagtggtttatccatccaggtttcaaatactggtcatacacataaaagagaagccatgatgcagaattccttttcaggcatctccaatctgtgatttactgctgttggccattgcctgtcctttaaaaaataatagttatgttttaaatctgtagtaaggattggtttaaaggaaaaagaaattgaaacctacagttcattttcaaaaattataggtgtccagttttgattaccagaacaaggaatgttcggtccatatatatggacagaaaagcaccagaaagaaaaaaggaaagaaaaaaaaccaggtacatgcatggaacatgttttgggtttccattggacttatgcccttagatctagtaaatatttcttttccatttaatacttaaaagctaaaccagtatcgtggggatcaattgttagttgttatagttgcttttttctatgatatacacgcattcattcttcaccgtgtttgttgcttgcagaaaagcatgggacatgttctttcccagtaatacaggatgaatatgactacttctccacggtccttgatctgtactccaaatacaatgttacggttagtgttggaagcttttgcccattatacctactttaatagatctcctaatgtttccttttcatttctactactgccttgctcattgtaagtctatgatcatgttagtcaccttttcctcaatttcagatttttctacactaaaaaatgacgaaactcaacttcctgcctaacaagtaaatatacgggtcatattctgtcatctgatagtggaaagcaattgcattcaaattttttcaagaaattaattatgcggtgcctgttatgttttctaatatttatgaaacctttcctattttggccagatcttttcaagatagcttgagttaggaaatctcaatttttatgtccaaggaaagttggaatgttgaatgttggaaaccccatcttgtactgaacaagcagtattccatgcaagaaaatattgaatacaagaagatttgaaatgcatttctcactacaagtcaacaaatcatagcattcaccaggtttcaatatttctgcagtgctctttgtgcattacaaatcacaggaaatggtagaacaagcagtttgttatagtaataataggcatattatggaaccacaatgctagaagcagatcttactgaccaaataaggtgcattatagaaccaagtggaagcaaagcttataattaataattaactacactatcctttaatgcatccattttagagtattaagaaagtcactctgcatggtatctgtaaacttgagttatcaagcttccattttgcttaacagtttgctgtgcttgcagagaattttgagcagtgcaggtatcttagctagtaatggtgacagatatccattgggcgatgttatttccaccattaagaatgcctttggggcatcacccatagtggtttgcagacatggttctgtggaggaacttaggttgtgcttctccaaggattttaaggtcagccatgactttccacccacaaattcgttccagttgcctcactatgcaggaatatcttgttcatacaactcacccatgatacacacatttatctgtctacagacagatgtttgggttattcacttattatttgtgattctagaatttagcttgctagtcaaggccggctgtttgctatattgttatttttgccaaaaaatctcacatagcatattcagaaatttgcatggacagaaactacatccaaattcctctaaagttgaaggtaatcgggaaagctgtaaatttagagactcaggtcatgttctaattgcaacttgcaaggcactatcacaagtcacaactgattagtatttttagcatacatcataaaatgaaaatgcaaatgttacaataaggatacataccggccatttttttgcttatagacagaccagatcaaacaactttagtacacggataagcagttgttcctagttgatatgggcaggtacctactaaaggtattactattttagtaatgtaattcaaatgccctactcttcaatttttgtccatctaggtcctgtcaccatcatcatgaccactatcctctcctcaccgtgtctctatctatcctccatttctctctggtgtcagcttcagctaccatcgctacctttgtagttgctctgcccccttaatgacaacccagctttgttcttgtcattcttctgttgggctgtggctggcagtaggatctttgtctgctccatttgtggtcactgttccctcttcttcacatctctctatcttccatctttcttagctgccacttgactccaccccactattgcagttggtctgcttttaatctcccaactgatctcctttgcatctttggccttattgttccctggcactgttttctgttaagactctgacctgcggccgcttcttccaccatttgccaatggtccatctttcgcccccacacatctttgggaatgtttggcattgcttaaaaaagtgcctgtgcggcttttaaagctaaaaagcacttctgcaacaaaaaataagtactggccaacattatatcgaaagtgcttctacaagaagaaaaagtcaacaaaacgcttttaggagtagctggaaaacttatcttctgacttctctttttataaagcagaagcaacaccaaattcgtctattagtaatgggagaagaagatccttactatttgaacagtactgagtttatttttacttattaaagtgaattttaattgagagacaaacatttgataacccatgtatgttcaaaaataccttttctgagcccttagtttgcttccaatttccatatgcaatttgcttttcttagcctggcaactgaggttcccacctttttgtggaaggtgattgtctgagacatttgttttttgtctttttttttgggggggggtacaaaatcattcttttctctttaacaaatttattgagatgccttattgggtggtttaagtcagatttgtgatcttcggacataaaatttactttagaggctaccttcagtattttgatattagcttttgaaatcagcaaggattctagcaaattaggtgtttgggattgcattatccaaatcatatatagcatagattttgctcaatatgaatgtatgatcctgcatgtatacaaggccttaattgcactgtgtctgcttttttttcagcctcgtgattgcacgatgggatctgacatcatagatgatgcatcatacttgagaagctcttgtcctagatatgtcagtttacctacatatgcaccgctcggtgagtttttcgttttatacatctttaaatcagtttagtcacccctcccaatcatgcttaccgtggatggtcaggttactttcttgtcaatatagcgctagatttacagcttgtactcactctgtgctattttttttttggcaatgtcagtgcttggtgatgtcagtggagcaacctcttggtcaactgatcattaagacgacgaggcctcttagggataatcatgttgcaagatccttgtacgaaattgaagccgagtaaaatatcgtgatagcagtgaaacattgtcaacctaagtagttagccatcctaaaattccatacggctggttatcttcatcgtgtaaattgcaaacatttcattcaaatatgcgaatgtaatatatatatatccatgcatggtcctgatactatgaggttattttcctttccagttatagcggttttagaggttggttgtgataactgatcatccatccgtaccaactggcttgttaactaagatttttatgaataatttgtcagttgtatcgttttaaaatccttattagttgggaattggtaaaatgcaaaacgttcagcctttgaagctcagggaaaagttctctacgatgacttgaagctgaggtgaaggaattgaaactctgcagcgttgcagagtgcaagatgtgcttatccacatgttacccggcgacagaacggaagttacaagaatggggaagttagctgatttcccaatccctagaatttagcacggtagaaaccgcccgcatttcaaagattttccgtatctgtgatatgggggttggatgctgccaaatacagtaccacctcttttcattttaggattgggcaaataatcgagacttaaaaaaatttatataatctaatctaataaatatcgaccagcatgaatagaatgaaattaaattaaaatttataaaaaattaattatttataatcaaatttgatttttacattattaatttatataaaatcgaatcaaatcgatataatatttcataaatttatttttatttttaaaatattattatttaaatttcaatacttcatttttgacaaacacctcattatccatttaaattcataaaaatattaatattaaattattaataaaactatattaattttaaataatttttaaataaaaaatattaaattaataaaaaataaataaatttaaataaattaatattaaatcgacattaaaactcaaactaacacaataactaacccaacctatccaaatccgctgtaaatcgtttattttaattttaaataatttatatataataaataattaataacagactaaatttattttattcgattagataaaaaatttttcgacctgatcaaatcaaactcatgctcagccctactccatatccaacttttctctccgaagatacacaccgaccgatggaccatgattaggctgtccgaacaggccaaacagcagctagctgcagcattcagttccttttatatacaattttagcagtaattatggacacgattagacatgtacaagcataaaacgagcaatttagctgtgtaatgtcaactgtgttctctctccaagccccttcccgtacaatctgcgcgaacaaacagaattgtttgaagaatttttttcttcccataattcttgcaaatgcacacgcttgctagaaatacacgaacattgctttcaatctggaagtatgccaatctcagttatttataatacggtcaaataattgtttaatcttatcgatggacttgctgatgagaccgcgtctgtgaatgtcatgcaatctaaatccatacgtttgactgcctctttatatgcatacctcctgtttgacaagtttctcgactacctgatgacatgaaatctttatttcgatgcatggatgcaggatcagttgatgacagaatcttgacatgtttctcctgcacgataactttgagtgatcgaaagctggttcctttctattaatggaggtctcatgaaccatgatagctgtatatccctgtgaacaaattgaacatgggaaaatgacaattatattattctgtggtgcttatcacaaagacatggagaaatgaataaatatagaaacacatcacatatgaattcgtgcatgtgtgcatgcgtgtttcatcctgtgaaacaactgacttgtgccaagcctcctgcttttataggatgaatggattttgcccaacttctgtgcaatcttgataagcaagaaatacctgaatcacgaacaaatcaaaatggaggagcaacttctgcaggatcaatccatgatggtctctttgcgttatagtagaaatgtgcaatcatttgcaccaattcatctgccgttctgagttctgcatgcccaaaagccaaacaatggataagggtcgcagcattttttcagctaagatggtttccaataacatgttcacacctttctccctgtacaaaatcctgtttccctttaggaataatagttgtgggcattctttcactttaagagcataagctaagtctgtctcgatattaatatcaatcttgactgtctgcagcacataacccaagacatcatgatttgtcagaattaaacatgataatgtcgggaaagcgtacagtcaactcaaatttcagaaataggaggattgtgtacgcatcccagaaactccgacgaaaataaagaacactcaaggaatcataggattaacaattcagaaacattaaaggaaaaagtggcatactctaggaggcagtcgatctttagcattccaatataccttagctgccttctccagctccttcaaaagcctccagttatcagctgccctgtgatcgagcagaaaaattcacaagaaagtggaattcatttagctagttctgtaagtaattaaatagcaaacttaaggcaaatatcctcaatgttgtttcccatgtttaacattaatcacttaaaatttcacatggatcgcaacttggaatttgaaaaagtatagaatgtggaggttaatttacctataaggtcagctagtctggttatttatttgtagtttttaaatgacctatttctggaagcatcttttcttttagttgctctaacacacatccttggtatgtaatgttgtacaacttgaaataattgcaatattgttcaacttggaactccattcttatgtttcataaagttatacaagattgccaagctattagatttcagaagttggtaaatatcaattgccacaaacgatcaaaacatacagtgcttcatttccaattaaactcattttactataacacaggagaacttggcaatctgaaggtatgaaatggatctgaccatctttgaggtttgcttcaccctgtttgtggtttccacattaattcttgggcggcatccattgtacattcatttttttcttttgcgcacaatcccctgctagaattctgcgtaatatttgataagttcttataagttcgactttttgcatgcataagctaatagttgcattaacccaaaaaaaaaaaaaccactaaaaagaaatttatgattcaaacaatacccacagttcataaagatcctccatttagcaagggcttagatcttcatcaaacacgcccaatacacatcagtttattctgtcccaactgacccagacacctcaacaacttgatgcagatacaatcaatgaccttatattctctcataacaatttcactgccatctcaacagattgaaataatcacacaccataaaggtaggcttgcacctcatccaccctctttccatttatatcttgtcttatttatattctgatcataattttgtaacatgtcacctaccttcatcgtcgcctaatcataatttttctttcttacacatcataacatttatctaatagttcgcaatactttcttatccatcccaaatataattgtattccaatgatataacaggccattagtgaagtgaattaaaactcacatgaagaagaaatgtacggatccaataccttctgtagcgctcaaagactagaaccacgagagggctgggatggaaggcaaaggtctcccactccaagcagttgatctctttcacccacccctcatccatctctccctcccagtcgatctccaccccatcgacgaccacattcttgattggatgcttctcaaagtattccgatgccctgatcccccacccgatatccgcatccaaaggccagtctggatcctcctcttccaccacctccttccccccaccctccgagctctcctcctcctcctcctcttccaaagtcctctgctttaagacctcctctttcccctccaaaaccccggcgttctgctcccggatagaggcgaaggtcaggtcgagccggtcccgaacgaagtcctccaccgccgccgtctcactccgccggccgcgccgcggcttccgtgggatcgtggacgggaaggcgtcgccggagtccgcggtggcggttcctcccgccggggacttgggcttcggacgccgaccttttggcttcgtcgggttatggctaggtctggggtcgggaccggagttcgagttagggctcgggtcgggagtggctgacgcttttaaggggacgaacggttttgggcggcggcgagggtttctccgatagagggaggaggtaaaggaggaagagttagggcatcgggagtgaaagaagagtgggaagaagggggagttggcggcgaagaaatgggagaagggtttggggaagaatgtatggatttggagcgatgacattttcgccctcccggtcccgtaggaagaggacgacggtgcactcagtaagtgtggataaggtatttaaataaaactttgcgtatgtaccgctaaaaaaaaaaaaattaatatatatatatatatatatatatatatatatatatatataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaagaaaatcttcagcacttttatcgagtaattacatggaatgagacattcgcagctcaattgcacaaatttcgttccaactaacacatggaggtagagtttatgttacacaactctcatccctacaccattccctcccatcaaacaagataaagttttttttaataaaaattaaaataaaagttcttttgccacccatgtatcatgcaatctgatgccactttgagatgtaccctctacaccagcattgctacttttttttcctcaatttgagcagcaggcagctctagtagcgaaggttccttggcttggctgatagccacgttagccatacaaagttccaaatatttgcatctgttgaacattctatcagtcttacatactaacatattgtaagaagtggtataaacacagcagctaccgcactaatataaaagatagaagacgaattataattggctgaaaacacgattctagttttccctgctgcttcatagccagaaggatattcctggcagtagaaaagagaccatatgtgcaactcaagtcattatgaattctagaaaatatttgctaaaattttatttaatcactaaagcagcaggacatataaattaaaatgtaaataataacaatccgtccagtaattcaattacatccctttaaacacaaagatcagacttgagatgcactatatataggtccggccataaaaaataaccaaatttcccacgagtcttgtgaaacgctatgctctcttcacactaaagcagcctctgaagcataagagaggtgcaacaaataactcatgcaaaagcgaggagttttgagtcctccaacagaacgagcgtgagtagcttggcaatcttgttcaacttgaaatctttcctgaaataacagcttccaactggagttttcccccatcccagaacatgaatcaaacacaactatgttagaaaatgaataaagagctatttgtttagtatgagctctgagtcacacaggttatttgcattataaaaacacacactagcttatacagaattagataagtccactggtctaacaaactaaccatgggattcagaggtgcaataccaggaacatgagtggcacaataacactaggtacaaccaggttatatgttaaagcctaaaggccctgaactgctaagcaggcacaagcacaggagactgcattgatggcgttactaggtggtgcaatcaggagtattgctaattgacttagctcagaaacctttaaatcccctggtaaagttgctgggtaacaagtcatttgatttaacatggatataatcggcctagcaaacagccaaacaccatctccatggagatacaacagagatggactgttttgatgtatatttcccgaggcatgaaaaaacctgttgccaggaaaactgtcttgccattgcatccttcaaatatttcacagtgattgcaccaaagttaaaaactttgaaatggcaagcaacaagcatacacaaattagctccaccggtcagcgagattaaatattcatgctggccataaatgaaaaaacatgttacgttaaggtaccagttgaagggacatgctccaagaaaatagtgtacaccaagtgcgtatttgtgattattttacccgatattcgaaccaagcacctccaaatacctctgaaacttgccatattccctccacctctcaccatcttgtcattaaccatattccctccgacaaaactgccacatttataaggcccataaactgccatccatgggactgctctggcaactcttcacatgtggtgcctttctcggtcttgatctcctcagtgactttgcaccattctccaaccacttttcccatccttcaacaccactcactccacttgcaatgattcaggcacccaatatccaacagctccaacccataagcaagctccgacagccaataagctcttcctccacaccctgtatcttaaccatctctacacaaactaacaagtatcaggtaagtttctctatgttaagttatttataacaaaaagcccttctttgcctgtatatattgtcaaaataatggagttgatttttgagagaggtgggaccactgcccctaaggtcgatatgaacataactatgacactaaaagtaacgagtatcatataatcatttgataatatgttgattttatcttcagaggtggccattgaaggactttgtgaacatattcagtaataatcatgtatatcacctctacatcaatttccctcattttgagtaccttattggtatgatatgcttcttaattttgcacgaaggttacatccttggtctaactacatggtttttgtgctgatgatgctttttatgactaaacattgattatgctctaatgagtaaatacaaatgtcatactaacttcaattgaagatgatatattgtttgaaactcagaagcatatttttctctgatgctcatgaattatgaaaatgataaaggattcgacatccaaaaaatcattataatatagaaaagtagagtgttgtttcgaggtttcaccaatgaattctgtcaacagaaaagattgttcttacaagattaacaaaaaaataaataggtgaagtttgacaaattggataaaaaatccggttgctagcagacctgcagaaaggcataaccatgaccttgtatatggaaaaaaaaaatgtatgtcgtgcttacacatgaaaatgcaatgtactcatattgctaaaaaggaagggataaccccaaaagctgcccttaacctgatggctcgaaaagctggtagccatgccaatctctaatttaacttttgtgatcagaaaaattatttagagtaacatgtcattattcatgaagttgagattcagagcatttatgcacaaccttgcagaaaggcatgatgctaactgaggtttccataatgctgcagaaagacaggtgcaaagagataggcggatcacaatgataagttttatttgacacaactataatttttggctcctaattcttttttaacaaaccagtcgcattcaagtgattgtctgtacacaagatgagaaagcaaccgaaaattaactcgacaaacaaatatgcagcaacatgtaatgctatagccattgtgtgtcaaggaactagtccgtttttctttgtgccacttatatgaagggaaattttttttaaaaaaaagtcacattactgtaggtgcaaaatcattggagccaattctgtgaatatgagaatgagaaagaattcatattggcatggtaaaagatagtggaagatcattttatctaatgggtaatgtttagcagcctaaggataattgcttgtgatattcacagtgataaaaggtgcaaaaaaaatcttagattggcactggttttgtaagctatgttgatagacactacatgtccaaaatgcgattggaaagggaaaggtattttgttttttgttagaaaaagcttaacataatttaacaaaaaacttaccataaatttatgttctaccatgtaaaagctggtaaaacataagatggatgggcatcatatttacaagccagagaccgaactgtatcagtgctagcaacttccccaaggccactaagtccaagttcagtagcatgaatcccaccagtaacaaatgctgatgcaattccagctgcatttgcaccctttatgtcatggtggagagaatctcccacagtgatacagtcacaagcatttacaccagccatggccatagctgatgtatagatcacctgacaaaaatttgatatgttacactcctgaaccacaaataaattaaaatatgttcacctaaaaagagagaaggaaaaagtatttcttctgctttatacattttaaaaaaaaaaatacagagatgaacaactaacatggcaactccaaaccaaacattataaacaatgctaatagatgaaaagtctaagttgactggtgaaatataatcaaaacattatacacgtgaatgtcaacatataccgatccaattaaaaaaatcaaaactagaaaagagacctagttgactactagcctgctcaactgcagatacccagatgtcaacccacacaaagcatgaactcacattttcttcatagtagagttaatggtgcaaacaaaatgaccaccattcaaacaaaagatctatattgttgatcattatctacaattaaaactgttcaaatccaaaattatacgttttgacggtctgcttatgcatcaagtgaatgctaaatggacaatattgatagcataatgtcatgctttgctatgatccactggtagaatatgggataatccaacaatatgatcaatcgaccgtctaaatttgaagtacaactagacacaatgattcttaggaaattaaatatattgttcatttttgcagtattagcatggtttcaattttcaagtgagacgatataaaggcttattcacaaatcttccattcttcatataaaatgcattaagactgtcataggcagggtcaaatttggaattgtcacatgatagttttggaatgttttctgtgaaaatgaagcgtcaagttgtataccaaactcatgattgatctaaataaaacatcaacaaaatacatgaaaccaaaccatttcttaaaattcattcactaaaaaggaaggttggaaaagagttagtagtaatgaactaattttgaaaatcagtttgtaaaactaaagcacagaacggcaccaggaacccatagaagagctaacgagggcagtcctaaccaagtgaccaggggcttgggcaccgaccatacgaacctttgaatctgattgactatctccaatctgcttcaaaaatcgtatgatttggagatccctacctatacattgcctgacaaaaaatggataatttaaaaaacaagaaagaacaaatattttttgatcattgaatgcataggctagggatctcaaaatcaaatgatgtattcatagcaagcatattagagatagtagatcacatacaatagctcaaatcgttggtgtcgggcccctcctcatccgcttaggaccaaccttattaggactcatgtgagtgcccacttattagcatttttctggaaacagccttagcagtaaatatctataagaggaggtgtactgggaacatgaaacgcaagaagagtagaaacaacttgctttttagggattcccctattgaaatagcaagaatgaagaagatacaaagatgataaaaaaatgaggagaaaaagaaacagcctgggctgttaagaaatatcgatcttcctcctcttcttatcttgttattcatttttcttttttgctgaatctttttcctccatatattcctccagcaccactattcttcttccaacccactcaaaaagaggacttagaaataggtgggatgcgtagaatatcgggtgccaatctgtaaggacctcaaaccaactactgtctggtaagcagcagggaattgtttatctaatcgtcaaccatccatacaggtattagaccatgattagttaacaaatttcttgcagtttagtcaaaaaagcaacccacatccatatgtggaatccacaaagcgactgtataagaaattgcagggatagcctataagtgactatccatattcgtcaacttctgctatatcctggggaggccccaaattcaggggattgtcaatggcttctgtctagtaatctgactagttcagaactaaaaaacctaattacatgattaatttcggaacctatgaaaattcctatatttctgcacaaaagtttcctgactgaaaaataaagtatgattgaaggagaaattttatcgctgggagatagagagaggtttgaaaagctacaacaaccactaaaacaaaattaacccattaccttatcaggtttacccatccatttgacttcaccaccaagcttttcatacttagctcctagagttcctagaaggaggaaaaaaattaatgtcccactcatcacaagtatttaatttcatctttcaaactgaatgattgtacatgatcgaaaataaggaaaattcattcaggattaaagactaaaagcatgtttccagttcaaactactcaaagcaaaagttgctttctcccctgccccctctagatgacatttactacttaaataattaaagtcactgttttataaacttcaagttctgtcaatcataggtaaatcaagatcaatgagatatatgaccaaccataccaggcataacacgcaaagctcgagcttcaacagtcacataatcgggatttgcgatcaccataggaatttttttcttggcacacagctccaagatttgttcaagagcctcaagattcatagggagcacatcaccagaaggaagaccaagtgcttcagttccatgagccagtatgaattctgcatcatccacattgctcacaacttgcaagcctaagccctgaaaagttacagatattgagatgagttagttgtctactaaaaatgtataattttattagaaaagaataatgaaacaggtaaatcactgtttctgctgttgaaccatccaagtatttaaaaggaacaatcatcaatggtaatttaagcccaacaatttgaatgaaataattacattttttggtttcctgagagaaaggtcaaataaaacatctttattttttggcctcagtttcctgtgcttttttgcacttcctgctcacattatcctcaggtcctagccaacttccttagggctgttagataaatttcaataaaacgacccctttaggttaaggtgacaacatatccatggttcaacaaaaataaaacatttggcagaatatacatagtccaattccggtactttaaaagaaactaaaaggaaatacagaaaaagggaagttcatgataagcttagattcacaaaccacagacgatcataaactcaagctcatctatgagcctaattttgatagaagtaaattgtcaactgcaaatactggaaattgacattgtaaggcccttgagtaaaacatttgcttaagaaaattcatgtagcaattatcccaaatcactcgaaactccaaagattcgagtatgtcatttcaaaattatgcttataactagccactaattcacgcaaatatcagaagggaagactaaagaaaatcaaagatgtgaacatacctcgagagatattgcaccgcgatcactccaagtcatgtgaatgcaagatcttcctagtgctgcaaaccatgaatcatccctcctatttacatcaaatcataagcaacactcaacaccatttcatgtgaatacaagatcttcctaatatttaattcataaaaagctgcttaaatagccactaaatgtttattgcagtgttccgatcagtcttcttaccatttacatgcatattcagattctcaaatgggcacattatctactaaacttctgaataatgacttggtggctgattgaaaatttatggtcatctatgcttgatataataatggaaagtgatatctaatagattattaaacatttccctaactacaatcttttttttgatttttcatgatatcagttcctttcaccaaatgttttctacttgaaaatgaagaaccataaggtttaattgatcccttgggatggaaaaaccatgcgaaaagatgagaagatgtgattctggtattctgatacttttgccgacaagcaaatgtattatgaagaaaagctccatggagcatgatttgtaacgacagataacgaagacactttgaggtctagccttcataagaaaagcaaaaagacaaagcaagagaaaggctaatagcataaagtggctcacaaaggaaaccctaaaaaaaccctaaatgtagcagcccaatgggcaaataactggtaattaggtataatagcaagctgcaaaaaagcaacttgatattccaatcaaatgacatcaaactttgcaaacaaatgatcatagtgagatgtacgattaattgacattgtatagcatgggaaacggtagctaactttcataacaatatctcaacttgctaaagtggatagattagatagggcactagagtgaaacatttcatatgaaaacacaagactcataaaactgaggatcacatcgtagagaaaacaagatgaggccaaccacctagtgcatctgatgaaagaaaaaatggcaacaactgacatccaacaagtttattgggtgtgcgaagcaaggtcaacctgagtacaaatatcaagtatgaagaaccaaagagcaataagtgacaaaaaagggagttagatggcatgggaaaagtgaataattcatgtgcccagcaaataagctgaacaaaaggttataaaggataacactaaggtatgacaaacaatgactgtggctgcatatggagtgcagatacacacacacacacacgaatgcaggcatgcaaaatgctccacatcatctgttaaaagaaacttggagtatcatcaagctacagtgtgtcaggagttgaaagcagacgatagggaaaaagtaaaaaaaaaaaaaaagactactagaaataaaagtggtacatgactcaagaggttagaaaaataattggccaatataatgcatctaatagcagtaaaaacgatgcaaacagaacagcacttcaagtatcaaacccaaggaagttgaaggattggtcattcccaaaatagaccatgatagcaaggagacaactgagaagtacaaggaaaacctcaatccaaataaacaggatctgaagccaaagggaatcttaaggacagataaaagcaagggaaggaaaatatgtaatcaagaaatgggaggataagtcgaaagaccttaaaaaaaataaagctgaatattttgaaagaattgttagagagagaagggggagagacccacctgcactatattatccacgttccagtttttgggaattcactgcaaaagaattgaacccagaacctctagtagcaatgcaaagggatgtcaccactagggcaaagcccaagtcacacccattggcaaagaattagaattcagagaagaacccttaaacaaaaatactggggtagcttgccttaaggctaagtatagagaacaaacatgcactagagcaaacaagtctgactgagggccaagagtatagaagcaattgttatataagaaagaaattaagaaaaccaaatggatttagcaaatataagatatcataaaagaaagcattgaaggtctgaaggttactagagaacaatagcacaaatggttactacctggacgaagtataatgtagagaatcaaacagtacctagtagtcaaaaatcaccatgaccacccccccactcaaaaaaaaacaaaaaaacaaaaaaaaacccaacaccaaaaaataaaatgaaatgaaataaaatataaactttatgatgttaaggacccaaaaattgaagattagaattgagatgagatgaagcatggaaacccaaactgaattcattttactttgttcagatggctggtgataagtaaagatgagaataatctgaaattatacttcaggtattccaaccaggtccatgaaacttttgaaactaccaataatttttgtcaatttaagtgatttttttccaataattttgtttagattattggaagcagtattcttatgcatacaattacttcatgtacatctactagcatacttatcttacaattttaagaaatttaagagtatgtagtaaagttaggatctgcatagttcttaaactagagtcaataatatgaagcatatcttgaacatattctaattaagaaaagactgacctttcaaggcttctatgcgttaattctccactagtgattgccccgataaaaatagaaggatcaaagccaaggctctttagcttatttatagttgtagatgctcgcctagaagaattactaatgattaccatcttcgctccatgatatgctagcttttctactattataacagaatgactgattaataagtacaacagtatcaggtggtgaataaacaatcactgccaaattttttaaaaaaattgaaacaaacaaaataaacatacatgttgaaatggcaccaggatatggttttttcccatcatgaaggactccaaactgatccaagaaccatgcctgtgatgtagagcgataaaacagtgagaaaagagcaagaatcaaaaaataacaatttcgtagctgagccaaaacaacatagatatttatcaatccaaaatctttgctagatcttgtagcagttttgataaggggtgaaatatcaaatgttgatgaatctgcaataccatacagggaaatctttggatgatgaagcaaattagatgcgagaatctaagaatcaagtagtccctaatcagcataaaaacttcgaaccataatttgaggataagggagtagaaaggggattgcaagatcacaagaaattgaattttttccttaaaagaaaataggacacgaggctcctgccactacgggatctaaggagggttagatgtccgtaggcttatccccacgtgcagagaagctgttttcatattttaaacccatggcacccaggtcacaatggagcaatcttaccattgtgcgaaggcacgatctcaaaacatgatagtttatctgttgtgaattattttagattctgaaaattagaaatggtggcttatctattgttggatacatgcaagaaaaaggattcttgccaattgatgcataacgaaacaaggtgccttcagagattttactaacagcaaagaatgtttagggaaaaacaaaaactcctaaaattagtaagaagaaaaggagacacaggttgataaatattgaaaatgataaacagatgaatgaaatcattgtacagacaagaagaaaaaataactgattctgctagtccaggtttaactgctttgcaaaatcttggtatattcccaagtgagtatggacagccatcttagagaggtctacacagttgtacactctacataactctctctatctctctctagcaccaaaccaggctaaatgagtcgcttattttagaaatgcttctcttctatcctgtatgattggaaaagatctcctcaattcagaaaacaaatgagccaacagtccaagagcaatggacgactagtggaggcactagttcagtcaaaaaccggaaatccctatgttttacttacttctttacatcataaatgacttctattaataggtttaggtggaataagaggaacaagaacaagtcaatgactagcaggaaaatgtgttcattaatattatcactgacttcatcagctataaaattctagctaaattatcaacaaataaagcctgcatgtttttctgctctgttaactccatgttaactccacgatgatggatggctcagctttcagttgttaatgagccagtacattaaattttaacagcataaaatagttttggagtgacgcattggtcggtaccatttgtagcgtattacacgaacatgcaaacattttcgtgacatttttctataaacatgtccaaacataattgtttgatcggtcctgcctcattcttgatttgctcaaagaaagaaaaaggaaaaagagacacgaaagcatgcattacacgatgctatccagctaatatcacagacacaaagaaagaaagaaagaaaatttggaatcccggaaccttaaaacgaccactttctgcaagggttcggatcccatccaagcactggaaggtccgcgacatctcagcactgctgcctccttggcacgaagaaatcgagcatctgagcgccatattcttcccctcgaaggcgcggcggaaatcacctgaagatcgaccgaaaaagtgagcagaaacaaaactttgaagcgaaggggcccttggggttttaaatcggtagggaaagctacaagttttcgaagtggatcgaagaggagaggaagttaccgtggggttggattcgccgtgttcttggattgagaggaggggggttcagcgaagaggggactgatctcatcatcgccgaaggattgaggccgccaagataaagagaaagggaaaagaagagcccgcaagcccggcaagaatggtctggttggacctatttccaatttgaacctgagcccaaattgactatattaacgcagggaaaagtgatccctgttcccatttcatatatatatatatatatacatatagtgggcttaaggtgcaatttgagggtttaactgtcttcttttcttaccaaaaaaaaaaccaagaaagtgaacaaaaacaaaatgatataaaactagacttttttttttcttcttttgattactcccattatatatatttttctttcttttgactactcctattatgctctatgatttattctttatggccgattggttggtccaaaaatattactatatattcatgaaaatatatggaacaaaaaaataaaaaaataaaaaatcaataatttattccaacagacctgatcaatgtttgtagaatctcgaataaaatactcgtcttctttcattaatcttcatgcataaaatatattattttttttcttttcttatctatgattaaagtgttagtgatatatttttgtattgatgttttgaatccggtcaatttataaaatgagaaccatgcctaaaaaattcaaatgccacgtaggctttagaatttattcttttcttgtatttgttttgtccgtagagtcacctcactaatcactttttggtggaacaacaaccccaactgatttaaagataatgtaaagataataagttaatcctaaacatatcaatttccttcttctatattttatgggttgaattagttttaaaatttgataggttaaatcattcgataatatttaattctttctatttgaagtattctttcttatataaattaaataatttacgattctatttattatactactatatggtacattttattttataatataggtttactgtaaaacaaatttttttctaatgaaatctaatcaattagattttcttactgttactcaatattattgtcataacaaaacaaacaaatattttaatccgttccaaagccgcgatctaggatgataaattggtaattcccagtttctttctcacttaaatcttttttagaactttcttcaccaaaattgatgaataatttcttgtttttgaatgggctaatttgttaccaataagtaacccattagaaagcaaaaatgttacaggagcttcctgatacatcctaaggatacagagaatatctgaaaaattcctttgagctaacttggacattgaagcttagcttgaaaattatcatgatgattcaaaattttgtgagttggctgggcttgattgaagccattggatcgtagcctgacaaaatccacaccaatggcaacacaattttggcaccatatcatattatttaatgattcagaattggcaacatcagctagctgattggtgaagcatatcagctatcataacagcaatatgtgtgtatgtccggatatatgtgtgtgtatatacgtacatatgtacgagtatgtatgcatttgaaacagcatattgctttcatattcacgaaatgtcaatcacatcaacaagaatcagctgaggtataaggtagaaagagtagaaggtttcaacagggttgatgatcctccaataccagaaactgtgagaaaaagaatcctaacgtcccaagtatctccagatttcctggccgttcgctgccactttctgcattcctctgcttcttttgctcagcagattcccccttggtagccagacatccatgcagccataatcctggggccatgctagcattccatgcaatatcagagggagctaatatatcaaagaaaatttaggtatgcaccttatttacatgcttggctcaaaaactaaatgcttgctcaacatccaaaagtatcaacaagtttattcacatttagatacacaacagatgacaacagaatgagaggtgacaagagactgaaggccatgttgcccaaccactgctgcaattgaaaccaatgtaggtgagaccaggcttgtttgttgaggttcagattagaattcagtcctgcaaatgttactgactaacagatccaatgaaaagagagcataattttatctctccatcaaatgtaatttaaatgtatataattgcaaggggtcaggcttgacaaagatgagcttcccacgaagaacggaataaaagatatatacagaacttcaacctgcaaattttgatgtagctgctgccactggacatgataaattccaagtcagttgagtgcttatgagcaccacatgctcttgagttagacgtaaggttaaagagacacggaagagaaactctgcggtctaaaagccttcatccgttctagagtcctgatggtcctcagtgcacatatctagaaaactttctacaggtcccacttctaagataagccattctaagacaagccttcaaacctggcatacaaataaatatggttctcaggatcaaaacacaagtttcatagagccttataaaccatctttaatcaaataaccatgtgataattaagtttcaaacaagacatcctataactctttccctaataacaaagaattaggtgccgatagaacaaaaaaaaaaaggaatggctcaatgcatgaggcttctgccattgtaaagtctagaaagggttaaatgtccgcagctttaaccctgcattcagagaggctgcttctatgttttcaaacccatgacttccaagttacaatgaagcaatcttacccttatgctaaggcccatcctcaagccacacacatcaatctcacacataaatccaaggatgaaaagaagaataacacaaaattatacagtggcataacggataaaaaaaaagtccatatattttaataaaaatcagctatataatgtcagagtaaatgaattgaataaaaaaaaaatcaaagcaaggttatgtgaacatgcctgaggtggaaattttgataaaccctagcttacctagtccctaaggtggaaactttgataacacctatcttacccagtccttcggccaaaaggagcatgatcttcctgcatcagttacagaagttgcattactgtaaatggatatccccaagatcaagaataaatattgcttctacactatatcgttaaatgaaaaatcagacaataagacaaataataaatagaaacctgtagcatttgttgatatatccactgcatccctgatgaattcccaactgtttgttggccaaattgaccctgtaaaaggtttgttgttcaataagagatctgaatgtaaagctcttcatattaattttttttccttttgtgagaaaaaaagcatttagtttagccagcacttctgcaccagttcccaataatatgaactttttcattcatcaccttggaagtccatgaatagagacaagagatggaggaaagaaaaacacatctgtcaatggttattttgcaaacctgtaacaaattggcagactgcaactggttaccaagatgatgttggtggttagcttgaagtccaaaatggctaccaaatgacaggtcatttggattaacttcctcctattgacaccatgatggaagaaaagagtaagcatctactaggtaacttatgcggttataggtgatgtaaatctatgagaatctgaaagtaattttatagaagcataagaaggatgagatatttaagtaaataggagaccattagatcaacgccaccatgtgtcctgatatgactgccaaggtgtgaagcagttgaggcagcttgaaacacattactctgacccccatctgatgatgccctcaaagagtcctgcccagatagtgtagatccggtcacaatctaacaaacaacgattaaaaactaaaagatgaattatcttaaactactcaagtaccttttgattacttggactagatatcatctctgtattagagtcttctttccttttctttggtggacgacctctgcgctttgctggcaaggagttaggaattttgttaccctcaacaatgcccagctgggatgccaaatgattttcatcacttgcatttgacctagtttcaaatgggagaagcctacgttgcaagtctcggcacatgttatcatctagaagagacttttccacttcccttaatagctttaatgcaaggtggtacttctcttcagatatcataccaacttcaacaagttgaaggcaacgcatggatagataatcataccgctccattcgattattacttgcaacatcttttgagtaccgatccaaagcaaacagctgcttcaagtcctttgtccagcgttggagaatgtactgagctggaatttcatacacttgttgcaacttaagcacagataatgcatgtctgcatagtatccctctaaactgaaaagagccacaaatacattcaatgtcaaactcatctacattatacagaacttcgtaattcctatcttgtgccttttcaccaccttccatgaaagcacattctttgacttcgaaggtagagataggaccatcaaccttcacaagcgaaacctgacaataaacaatggccttcaactcatcctgaaattttttgaacatgttaagcgtatatattttggacagatgctcttccatatgtaattttgttacaaagactcggccctcatgaaatgattccaaatctgcccgggcttccatttcatatttagtttgtaaaaccatctcataattacttaaaaaacactttaaagaagttcctggatatacacacccttcaaaaaaggtagttatactttccttgtgtcttgcaatggacatcccggcccagaatgtgttttttaggaaaactggagcccataattgacgattttcatataagatattaagccattcactaccttcgaggccatatctcttcatcagatccctccagccttcttcaaattcattaactctcaacgaatcatatactacttttttcaattccttcttgagtattttgtattcttcaaatccgctcaagttctgttgaacatttttcattatatgccataagcatatacggtgacaggcttctggaaaaacatcagcaactgcaccttgaattgccctacattcatcgataattatggcatttggagggcatcctcgcatgcatgttaaccatgccttaaataaccataagtaattttcagtggattcatctgaaaccaaaccacatcccaacaacactaactgaccatgatggttcactccgacaaataaagcaagaggaatatcatatttattttttaagcaggttgtatcaaaataaacaacatcactgaaatattgatatgctgctctagacctagaatcagcccaaaacacattcctcatatgaccttccacatccaaatccagcaagtaaaagaaatttgggttcttagtctgcatccgtgcaaaaaactggaggatggcttcgtcatcaccctctccaagcttcaaccttcctccttcaatggagtttacacattccttatcaccaaatagcaagtcttcatgtccagccgctcgcacagcaagatccttagtcattccactagacatctttttatagcatctcaaaaaacgggcagttgacggactaactgcatgattgtgttcaagattagcttccaccaaatgcaacaacccatcaccccataatttcactatgatcatagcttggcaatttgtctttgctgtaggtcttgactggtagcatgcatttgcccgtcccttgccccccttggtgcatacaagcactaaccgacgacagagaccataagttgtaaatgaagacttttttacagctacaccaaatcctacatgcagagcataccgcttgtaaaaattaacaacttcttcataagatttgaataccattcccaactgaggagttctatcatctagtccagtgaccttatgaccctcctctagttcagccttgtccatttttccaccatcatcatcgtcattctcaggagcaactgctgtttttccttcatccattggctcttgattgatagaatcagccagcagattctgaaagaatgaaaaagaaccccctaatatatttatttatttattttttaaaaaaaaagacaatagaaacctcatcacatgtatatattgaccatattgcctacagttatagagaatatgacagggtactaattcgacaccaacctgagatgtttcatcttcttctgtggttgttctgtcattcacctcatcctcgttgcagtttttatctaaataagcatcaccattcatcaataatatttctttctcctgattatatctgctttccatgagagaatgattggaattcccctgagagaagcttttcgagtggatcatctatgatactgaaaacataaccactattataaaagaaagcaagaaaggaaggaagaaataaataaatactacataacctaccgctcctaagaaataagtgttcagtggcaaggaagattctccaaatagttttagtgactgaaatataaaagtcccatcttttcattaaaacaaaaaaggttttcttcaacagtaatcaccaatcaaagtttttaaaacctaatatcttggtgacatcggtgggtggctgatgctaagatgaaaccaagatctcagattatctcagccaagatggtagcttgggagaacctggaaagaaaccagaaattctataatctcagctgataatatcagaatcaagatactgaagtattggcagtttagaaaagatgaaattaatcattgtttaaaggccttgattctaatatgcatacaataaaatccatttaaccttgcaagtaaaagattgaaagaaactactctgatacatcagtatagatcagtctgtattgacaagataataagcaataagggttttatatataccatggtggtgaatgcttgatactgataaaacccatagctaagccaggatggaaacgttgtcatccagaaactgatactatggcaaaaaagggggaaaaaggggattgtaatggttgtttggttgtgtttgaggtttatcaaagcagataatcataaagccttattttctgtaaaatggggaggctttttttccccataaaactagtttttctgggtttgttaccggttttcacaagatttttgtggaaagcattcataaaattcatttcaagggtttgtacataactgtttcagtaaaaacataatagaagaatcacaagaacaagtaattaggttgaaattggtgacgcatatcaaataacctaatctaaatcttttgtaaaaactgatagatgtatataagtaatgggatttagcctttcccagatataataatttggcagaagaggtacacaggcaatgagctatataatggaggctaaccctctccaaatcatggaacccccaaatgttgatgaaggcaggatttggacctaggccgctggcacaacgactaagacactttaccagcttggcaagcggcaagccatcgcaatttcagatcttttgagtgattagaacaacacttggaacaggaagataacaggtataagtagagaatctaagcaatgtggcagaagtgatcaaaaaaaaaaaaaagcgaccccattgatcaacacaattatgacagtaaatttcatagcgaaatcacattcaggtgacatgaatttcaagaaaaacctatatttttctctcgacagtgagaaattttagattattaaccatgggatcccgactatcaaagccatggcacttagcatcaatgtaaccctcaatcacggcatctacggtcaaagaacccaagaaagagtcgggtaaaaattcatacaaaaaagattgcaaatttatacctgatacattcaatcaagaatcagaatttgaaacagccaaaagcaataccctaactagaccggaaattaccgcatcaaaatagggaaacggcacaagaagcaaacagtcgattctagaatcccctttatttttccatccttttgcttgagtcgaagagcagaggccggagacagatggggagaggatggggggacggtgggttttagggtttgatcacagtagagaagagggaaggcagagcggagcacaagatacgaagggttgcacccgcctttggacacccgctttagccacccactcagacgggcaggctttgggtgcggagtcgggtgcccctagctggatcgtgaaccgcacgtctcctattcggcgagaccagcctacattccagttgggcccggtatggaactgggaatatttggcaggattgaagattttcttgcatctctgctatgttatattactgagatgttaaaatcctaaccaatatatagccaaaccaaaataagtgaccatgatagacactaattttgaaactattccattaaaattttatttaaaaaaatgaaaaatattggataatactttaggattttattggattgcatcaaccgagatgttagggaccgaaatttccaatacattttatcaggagaggtgtgttgctgatgcaaaccaaggtggaaatcatatactttgttccaccaatatatttttgccattcagtatagaggtatgtaaaaaaccgagcacctcgcaaatatgtatcctttcaatagcaatgtatttagcacaaatatatatgtatgcagtctttatgcaaaaatatatctaatctaagtatagaaactttgaatgtactattgggttagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacaaataccagatatttatcgattgactcctctaacaataaacaaaatttactataatattgttcattttatcttattttatttttgaaagagggactactcttcctttttctatcatatatcaattccaccactcaagggctaacttatccatcgaatatagatgtgaatgtgaaatatttatctaccgactcctctaataatgaataaaatcaaacaaaatccactgcaatatcgttgattttatcttattttattttcaagattagaagaggccggttctgttctttccatcacataccattacaccaactccacgccttcagagctgactttaatcagaagtgaaccccttgctgagacagcaagcagtaatatcacccaaacaaacactttacaatccataatgcttaaaataaattttataatcttttgggatcgatcaatatacattaaaataattttataattaccattgttctaaaatttttaagtacaaattttggattaaaaaatacataataaaagacctccacaaatattttttaatatttttattcatataataatatattagctaaaattatttttcaatatcccacttttctttttcttccttgtgccaaggcacttgtgccgatccatattgatatccttacaacgttgttgcacattcaagaacaacccaggaaaatctacatcattaataaacatggatggatctgaggtccctccacgaattgcggtccaagaaaaaagatatcaatgtgaatccatggtacacctcgttctaattcaagacagagatagtagtttgtccctccatgcaattggatttcttgtcccaccacaagtcatatgtaacagtatatccatcaatctcaatcttcaacaattcgtcccttcccatcacatttaaaatcatttataggtcaggcatgacaatgacagaaaaaaggtgttaccatataagttgtccaaatcacttcagacatcaggaaacgacaaagtagacaatcaattcttagagctgacatcagaatcaaccaaccccctcataggacccattttagtcaaaggctaagaagcataacaatatcgatacgatgtaaacaatcatacaggtgggtaaagaccaactgcattatgaaggaacaagctgtgtatgtttgtagaacaacttccaccttcatactgttatccgttgctcttgcagagtgatgagtcttcattcacttgaacctccaactgttcatacccgcgaagtgggaacactgatacctgaatgattaatcaccacaaacattcaaaagataagatctaaatatgccgctccaaacccatcaaatgccacagcaacatctacgccttaatgatcagtgagtaccgggacagcaataccaaagatgcttcaaattgaagcagggactcccatggatcagcaaaagcagtgtgccagaaggcctcagcaccaaccgatactttacaaggaatacagtcgtatctgtattaagataccaaagattcgaaatgcctgcatagattccaatcaacttcgaacatcagcaagaactcaaagaaatgaattgactaatttgcatgctttactaactcactatttcaagcatcaaaagaaaaggaaacaattgccgagaatcattccgcacgaatatgcaatgcttctactcaaatgctaatcaataagctatttgagacatttacttggtacagcagctcatttattgaatcagttacaggtggttctgaaattatggcttgtatgatcttcacacaagacaattcttcatttgcatcgaatctatagtttgccagggatttcctcttggtgtcaggcagaattatcctgctgaaaccaaaattgaccttgttcataacacgtacatgaatcaaacatcaggttggatttgttttagatcatcaacaatcttcccattacccaaacttgcatcagacatgtacatcactaggtatgtttggtaattaatgtagtatacctacctatgcttagtaattaatgtagtatataacaatatcatcccttataaagtaaaaaaatggtttagatgaagagtagtattgtgagttacagttctaactctaattttattcgcattatatttcagtaaaacaaggcattaacagtttatttggcctaaggtacaagaattttttttttaaaaaaaaaggaagctataaccacggatgtatttcaacttttatgagaatcaaagtattcacacatcaaatcaaccaactgattttgttcaaatagaaagaacatcctaatatatgaattaagtgctaccaatgcattgtcagcgatcactagatgcaatctggaccacgacttgcttgggatttcaatgatgtagctcctggcgaatgcttcaggaagaagtatcatcagagaaacagactgcttgctcctaagaagatcctaagatttccagctacaccattcacttagagaacctctaatgtacgaaataccatccatttcaccctaacccatcttactgctctaacaaaatcactgaaactgacacagacattcaataatgtagcctcagaacactagatctctgtttcaactgcaaacatgaagtatagcctgcacctttacaacagaatttgaccctatacctgcaacattatctggtccccccacaccccccctacccccacaaaaaaaagcatgtaaatcaattttcttctccttatattaggacctgccatgacagttgctaagcacacagtgcattcttgagttcctcaatggctctttgcatgggtagttatttgcatatacaaaaaatccattcctaagttgtagtaccttgttttttcatataagtgatccatccacaagaaccacgcctgtattccttcaagcaaaagtaaaagaaatttaaaatatattgaatattgagttgattacacatgaccttaaactgcacatcttttggctataactatacataagtttcatgatatgaatgcatctttaagaaactgtacaaagtgcttagcttttaaagtgattgactaatttttgtagtttgcatcatttctgcttttctgcttagtagtacatgagaaaaatgaatttctgttctgaaccactaagtactgctaccatattagttgtgcagtagcaacagtcctcacatttatataattacatggacacttaccatacaagtattttcctagagattgtttggcctacaattctcacacgattctaaaagatagacccaacattagcatctcaactctccaatttttaaaggatacatgaagtaaacatgaaatattatcatacaatttaaaacaaaaggcaaggtactatacaaatattcacttagtacaaagggcccattcttttgagggtaaaagatttacccaggaatctgtatttttctagatgagtattttccggacaacatttagacaggaaaaataatttatccatgttcttttatgtattggaaaatgactcaagaatctgttacccatgttcttttgcattactattttttgagaaaaattgctaagatccatccatattttccataataccttttattatacaaatattattatacataataatataatatattattttattttatattattgttatatattattataatatattataataatatattataataatataatatatcatattatattataattatactattatataaatatattatatataatagtataatatataatatattgttatattattatattatagtatattatataaatattatttatatataatagtatattataaaatttatattatattattataatatattactatattatattatattattgttattattataaggttaagagtatattagaaataaattaaaaagattattttttcaattgatgaaaaaataatttagccacctccaggtgggtaagatttctccctttcatgaataaatgctattcatgagaaaataacttatccatcttgaaaagtgtaagaacatggataagttggtcaatgaaaagattgatcaattttttcatgatatttacccacaaaagaacaggcccaaaaaataaaaagaagatgggactgaatgctaaccttcaaatttcatttagtaaaattttgcatataaattgtacgagcacataatgccagtatttgtgaactccaagcggcatgttgaatttggcctgtaaaataaaagaaggaaaaagatttaacatgatacaagttctgttgatattttttgcaaatcttgaggtaaactagagcaaaggagtgaaaaaacaaacaataggcaaccaaggcaaatgcactaatggatgtgtgtgagcatgtgcgagtgaaagagagagagagaatggcaggaacctgaaggtgttgtggtcatgctgctggttcgtcagtaactgattccaaattttggagtcataactgccacttggagcaaacccacttcatccatgttttaaaacagtgtgcagaaagatgctcgggtatatccacctgcattaaatccaatgaaaacaatcaaagcatgaaataggaaagtggcggaaaatcgacgaacaattcatagctcttataccattatcgtttctagaaaggttatggtattatttttttgtaagacaacagaagaaataatgacctgcatccattttacgtaatttgagcatattcaaatatctattttaggcactcgaattaacatgactctactaccaccgcattgcataagcatcacttcaccttgcaaatgttaaccattggataaatgttatcatgacgttttatcatccaaaagctaaacaactgatcagtgaataggattattttgctaatttacaaggtaaataaccaaatggcaagtatagatcaaccagaaatctaggtggctggtattgtgatgcaatagatcagtggattatggtgttataacctttgtataaagatactagactgagttgataatcttaactttgacttagaaatcaaagatccaagatgctcaacattaatggagtgttcaagcctccctagatatacatttcaaatccaatctaatcagcttggaaattaaagtggataggttcaaagcgtcaaattttcaaatttctgatgaagcctccagaaactcatttccaacttgtcttatgcacccatccaaagaaggataagagtggatgaattaaactaaaaaacctcaagcttttccacttacaatggtccaatcccaatgacacgtattgagggtgagtcatcaaaacaacaaatgcctaaaagctctgtatggttgtggcctcgcacaagcttcatagttttcaagaaaagattgctcaatgaggctttgccacacaacctatcagtatgtatcctacaacctgtccaaggatggccgaagcttaccactagtttagggcatatcaaaccaaaccgatcagagaccaacacaattcatctcatatactcaagacagttcgagtcccccctctcctggcccgcttgcattgtttgagaagcccacccttgcagccccgattgtgatgttcaagtcctttatcacaccccaccccacaggcagccattcacgatggtccaagagcaccccccaccttctccagtaagttcctctctctctctctcaatcgaagtctcctccacctccccttgtcctcttcaatccctcctcatagggttccattcctatcccaaatctatccaaatcatcaccatgatcatcaccaagaagccgcacaggatcgacatcctcctcaatgatgaatcacactgggagccctccattgtggttcccctcggccctccccctccctctgcctcccagttgctatctcttcctcttcttttctcccttcccctcactctccctgtccccctccctcgtccgctctccttgtgtcagtatacctcagaaagcaacccatgcatcccaacttcgtatttaaccatcaagaatatcacttacccgtccaaaccccaatccacgaggaggaaggccatcctaacatatggcatattacagaagaaatgctctttacaaaatctagctgatagaaatcacttatgaatacctttcctcccatctgatttgccaggctacacagcaattgccataagtgtcatgcttatcatgttcaaagacctgatgagacatcacagtatttgttaactagaagcattatgtcaaagtgtggaatttatttatgacaaattccatatatgtcatcccaataggaagtggcagcctgtcaggcaccaacctttttttcttctgagtgtaaggggagcgaaatgcccacccaattttataaatttactagaggaatgagagaagtaagaaagagaggatgaggaggaaataaacatcaccgagattaaagtccacaacaagttctgcactagctgaactttgtcattttctaaacagctctgatccctgaataaatgcaaggtttgaatcgaaatggcttatgcaggcttctctttcaataaaaaaaatcctattgtttctttcttcccacatggccccacaaatggcaagaactaacttttatccaagcaacttctgcatttgctgaactttgtcatttcctaaacaactccaatccctaaataagcacaaggctcaaatcaaaatggcttgtgcaggcctctctttctttagaaaaattctattgtttctttctttctacagagtccaagcaggtctaagtttatttactattctcttccttctttaaacagtcccgagggagagtaaggaaggaggattaccctgtaattcattctttccttcaaagttctccaaacctgttcagcaaaagaaaaatataacagtatatggtttatagtcccctcattcttgtcacacaaaagtactactcttccaaccttttcttgatagtacatcccacatctgaagcctatttttgattgccagccacatgaatattcttattttctccagagcggatggagtccataaggaatgatgaataggggatttgtttccacccatgtttaggaaggtatagaatggcttctcagtgaaaacttgtccaaagttgagcttccaaacaggaacttcaggtcctcttcaaggttgatcaagctcaacaaggtacttaattcctcccattctttagattcttcagtagtcaaaggtcttctgattgccacattccagttatttgatcctgttccggaattaagcagtttgaagatggtcatcaatgcagtggcaattcagtaagtattgcattaaggagtgttaaccttccagctactgataaaagtttagccttccagctagagagcctcttatcaaaccttgcttattcttctttttttttatgagataaaatgaaggaagtaagatgcttccttcattaatatattacattataaaagatatgtacatgaggatgatagtatcgaaagttaacatcagcaaacatgggtagatggagggggccatggcccttaactgcacagtaactaggacccgtccctgcctaatttaaagatcattccttagagacttcatgtggttcttatcaaatctttcaaccagatgaattcagtcttatttagaaagccactgttattgaagggaaggcccaagcattttttacaatacgacatctttgtgactttcagagcctgcccttcattctccccaagataaatcaagctcttatggaaattaatacttaaacctgagcaacattcaagactacataaaatcatctttaatgtgagcatacgtgcacaatcagcttcaaagaataataacgtattatccacagagtgaagtctgctgataccatctatattgcccagagggtctaaacattttaaaagaccttgattccttgctctattgaataaaacagttcaaatatccaaggagagaataaagtgtaatggagatagagggtctccctgtctaattcctctgccacagttcatctagtttctgggctgcacattgactaaaacagccatcttatttgtggtaattctagagttgatccataatccactgtgaaggaaatcccctcttctgcaaaactttatcgatgaactgccaatttaactgtcaaaagccttcccaaaatcaagtttgcaaagaatatcttcctgcctatttcttttgacatcatgtaaaatttcatgaacacagataaagttagccataatggtttttccttttataaatacggtcctagcattgtcttttagtttgtcaagttgtgggagcaatctattagccagaacttttgaaatgatcttgatcaagctgtgaattaaggtaactcgcctgtagttggatgcactgatagcttcttttttggtgactaatgcaaggtaagcaatgttaaactgctcgcatcaaagtttcctacaaagaagctgttggagagatgcaagaaatcttcctccaagaactcccaatatttctgaaagaatagcacaggaaattcaaccggccctggtgacttgtcccctcctagagcaaagatcacagttttaaattcatctgagcagaaaggttctgctagagcactaagataaatctcagctgagtctgggtataaacaatcccagtgcaatgcaactccagtagcaacattctcaaaaaaagatcctcttattcagtgttgcgatcagcaatagagcaaatgtgatttctacttttatgattacttgctgttatgtgaaaaaaaaaaagaggaagtatttctatcaccttcaatcagccaatgaacatttgatctttgttgccaatatggttcctccataactaatttttaggagaagattttaattcccttgttccaatgagagattcccagattcttccagtatgtcaatagtttccattattccaaaaatgattttcttttcacactgcatcctccttaagttcctgccccagcctttgaggatttccgaaagtttcagaattagtgatccatgcttctgttatattagattcagattccactccccctcaacccccaccctccacaatttgcaaggcaataaagtctaactcagcttcttttactttactcaccacttctcaaatctaaatatgttgagttcttctaaaaagatgcagttcaataggggaatgatctgaaaattgctaacagaaataggcatcccaagcgagagaacaaaggaacctgaccaattttgccataattggatttttctctcatattactccaagcatattttctttcttttaaacaagtttccaaaagattatgcctcctaataaaagcagaaaaagcttcatgcattttcatttctatcatccacatgccttgtaaaattgaaatcacctcctataacccagggttcggtaaaaatctgtctaatgttatccaattcatcccaaaattcattctcgtggtgaacccttggctaaaaccaacatatactttggtgtacaaattccaatcctacattaatgaatccccaaattgtgtttattgggcaaaacctttattggaatcaagaggtctccactttggatgattttcaagtgaaatgttttttatgacattctagatttgttgttaccagatctatctgtctagtgtttctttgcacatattcattgaatagcatgaacttaactaatcaaaacaacaacagtccattaatcttggttcacaaattaaatgtctctagacagtctgtactattctgtgttgcttctctcagcatgttcatgcattttgatgggcttgcatctcatgttgcattatatattcatatacaaggactctaacaaaaaggactactaatattcctacaattccaccacctttaaagttctcgctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaaataaatataatgaaatcacacacagaaagatataaaatcaattcaaaacacaagtacaacaacttaaaacaacataaaccaacctaggcccaaactaggagctgtagacaataattctactcaaaatatgactccaagattcactagaaagatggcctcaaaaactagtacaagaattgcaagaaaataaaaataaaacttccactactgaagccttaaaaaaattccaatcccatcataaatggcgtacaatctacagtactttgacaaatttgttagggcaggaagtatttgctgttcctttgggttgtgatcaaaccaccaatttgaccagaatctagaatatgttcatctgtactagcatgtattcaaacaaccgaataagaatttaaatgatgctgatgactaatgatacaaaaaaatataatacattacagacctagggtactttagttgtgtggcccaatatatcacaaaagcatagacaaggatattgttgtaaagtaggaggagaagatagaaacataccatgttccacacacaagaaaagccatctgttgaaagcaaccaacttctcccacctaaatgcgtgccttggcatccatttgacggttcaaattccaccagctcatcaagaatgctctcatccttcccatatttttttctcttcttccttctttccctctttctcttcttatgaccacctctagttgaatctatatcaacactatccaaatcaaatccttctgagaattcatcagatcgtagcaatgaataatcgtcagccttgcggaaagttattctgttcctaataaacaatgactcccatgcctgtggagttttgcattcttttgacaaacaataataaagaacccatgactgaagaccaatccattttactgccaccacctgtttcatctgtatgcattctttcatgagggcccaatgatcggcatcactaaaacctgaggcattttgcagaagctcttccatgtttctcttttcatccccacgctcttcatcaccgatgaggcgtagaagctgtctgccttgaataacaacagcatttaataggagaatttcatcaagagatatgtcgcttttgcatgaggacaaaagattctcaagccagcaagaagggtatacaaaatccttgcactgcatattttgacaaacatatttactgagggacttcaagaaagccaggagcatgcactcgtcaagctgaataaggagatgccgagaaagatatgagaattgctcctccattaaaaattctttaatgactgcccatatatcttcacaattctcttcatacatcaaccgcacaaactgatccacaaaatattttttatcaatctgaataatttcaccatcttttaccgattcagcaagctcatcagatgaccaaaagtcaggtacatattcaagaaaattttccacagtctgcagaacatcaagattctggaagtaatgaggctttgtggcaacaactgctggtgattgcccatgcttccccttccactcgagctcctcccagcacatgtcccggttcacaaaagcaaactgggatattgccctagctccttttgtatgtcctgattcactggcaccagcaaaattatcaaaccactgcaatatgcgtcttgggtttcctgcagttcacaaaagcagataaaatgagcaatctgttgttaagtcagtacgttaaacaagaaaaacttttgcaattattaataagcgcatgcaaaagcaagaccgacaatacaaagaaagatattgaacagaagcaaattttactaccctgacaaggaactcaaacactcaacctgacgaggcatgagtatcaagttttaaggcataacctcattagttttaccaaaatgtctagatcaaggtttttttccaaaaaaaaacaaagaaagaaagaaagaaagaaatcagtatcatggtggctgaccagtaccaatatgaacaaagatcttggtttctctcggtcaagattgaaggtgggggaatacagaaagatgttttcttaaatctcagctgatattttatgactcagatattaaaatataggccagcatcatagatccaagattatcaattattttaaggcatcaatttaaatatttttattgattaaattatatatttaagaaaaataacaatcattgttggaagatattggccaatatgtcaatattatattggtggatatctaggattttgatgatttatattggacaagataacagagaccaagattttctatgcaccatatcaggggagtgtccaatactaatataaaccaagattttggccaagataaagccttggtacagatacgtccgaaaaataatatgaaacaactatagaagaggatgtggccatgtgggtgtgggctttactatgtagttggtatggatcgcatgttccatatgccaaatgtgcacaattattaacagttggtgtacaataacatatctcgctactgcctggaattcagtatgcataaaacattgtggaactatatgaaaagtgactcattaattccgttctgttttgccggctgaacttgtatgctttccacaaagggcattgcttaaaggtaaatgtgaattcacacgaatcatttgatacaatgcctattactttatgtccttgagaatgagctgaaaagaaattttttggatgtctgaccttgagatgtaggcaagcaaaacctctaaacagcttttttccaacaatcaaaccacaggccatttataattatacttaatataagaatgaagatagatgaaggtgcattggtacctctctaaaatatttttgtctaacagaaatgatctctctagaactacaagatgtttcattgaaaagctcctacacatgcaacatattgttgtcaaaaactacaaatgccatagctggacttattcttcaagtactaaagacatcttgtagtgtaaaagcattaatgaatatatgaagacaaaaaccaacagatactgggtatttacagtaccattaggaagaaaagaaacatatttcttggctaaaaagcatgtcaacatttaacaacaaatccaatatgcactttcatgaggtattttctaaaatctgcctttattctgtattatgtccataatccataattccatataatctggatcctaaaagtattaaaacttcataataggtcaagaaacaagtaaaatttgattaagggacacaaaattgccttcaaaaaatttctcaagcatgtagcatttctttgcaataacgtgcccagctttttctggtctcttctcaaaaatcatttgtaggagttgagcagctacatcatgctttaacaggctagacctcaacagctccataaagaggtcatgctgatctcgagtagtaatagtatggaagcgtgagatggtgttgcaaagccataggcgagcctcatatcggccttgagaggtcagtagtgaccagataattgattcaagtttctgcagaagagataacctctccttcacagcagttccatccccactgtcatcagatgctggtttctctaaaaacaactgcaccatctcctgttcaagaacttcaattttcatcaaccctaaggatttagaacaacaaaagaatagcaaaacaatcaagaaaatagaaatgaataaagaacaagataatgtaagactagcagtgatggaaagaaataaagtcgtaattggaaaaaacaagaatatcaccgatgctacgaaaggaacaaagacatcataagcatccagaaaagacgaacagcaattttgttattaaaaaaggaaaaacccttaactctgaaaagaaaccactctattacggtgttaacaaaggtttggtggcggaggaaataattcactaattttctttctttatttttctctgattgcatacatgagccatgttccacgcatggcaaattctcctctactcttgcattatcgattctctaaagcttcctattgacaaattttcctccctagggttgggggacaagcagccagatcaaattatacccaatttcacagatcaacgagacacaagacataataaataccgccaggtggagggatggaaacatacaaagaaagcttctttgcagatcccaccaattcccacggaaacatagcaaaagatcaacaatacctatcggccaataaaatcgatcttttttcaagatttcctaaaaagaaagaaggaaagaagggtaacaaatttttcgggagagtagagaactaagagtgccgtacctaacgaccttcagcgcaggagagcaaaaatcgccggtggccttcggtctctcgaggtggtttacatgagaaagaaataagaaaaaagaggatggcggtgcgagacccgaccatgttcgaacccggctcaggaagtaaacggctcgaggctttcaaatattttatgcccggttcttgattttgatggtcattttatattacgttactcgatccacatgcaagaatgaggtacataatgatggacatgaacaaatctaattgaatgtaagaaacggaactatctggtggaattgaacatcaaatattgcattgctttgtagggaaataaatatgactgattattttttatttttttttggtgtttttctcaaagagagaacaactgttgtgaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactatatatatatatatatatatatagagagagagagagagagagagagaatatcttactagttattgaagtatggtgggtactccggtgatttggctcctgaaataactttggagctgctgcaaaatgaagagaatgctgtacttattgatgtccggccgtggcaagagactgtaaatttcaccagcttcttcttttgcaatgttattttcatacaagaaatttgatatttgtggctaccatgacagattctgcacagctcttttcgatttctggtgatgaggatgtcctctatattcctactaattttcttcttgaatcataatattcgcctaatagccctctaagatattctttcttgactgtaacatagttcatatagtttttctattctttcagaggaatgcataaattaagtaatactaatacgtttgaaggtgagtatcactatagctttggtcatctcaagtggtttattggtaccagtcactaattcatatttatgactggtgtgtattcgatctatttttggtgtctccctcattcctctggccttgtgcatgtgtcttcaaggatgaaactcaaaccttgtggtgttgatgaacattcatccttcatggtaattgttgatcatttctatcaaggtattttgttgccaaagatctgtgtgcgtgtatgaacttcagataattgcaagtttttgggcattttgacaccgattgattgcaatttttttgtttagggttgaagacttgaaagttattcagctgtttgatggttccaagcaatctaatattgtgttattcattttacagctaataccatattattcatttatttttttaggagtgaaagataatgtttcttttccatgagcaacccattagactcgcacctaccaagccgaagctgacatttctagcactgagttctgtgacccaattcatgaagccttagaaggatatttaccaaaacaatgcaatgcaaccaataaattttagaggtgaccaagagtttaaggaccgttccagatccaaatcctcaaccaggaagcaatatgatgggacacatccattgaaaattgctggtttttacatgcctctaatattttataggaattgaaaattcaccttcgcatgcaatgctggtggagattgttacgctgcaggaaatgaactgttccctagaatgtggattgcatgtaacatatcatgttcatattttagtcaggattggaaaataaattcatgaaatgtgagcacaacgatggtcaggatatcttgagacaaaactaataggattggcaacacactgaaaaatttaatggcagaacaaactctacaattccttattccagattagtatcttagaggaaatatcctcatccagctagcataagtgtttatcgaatttagcaaagataggaaccatcttacctgccgaagcagttgcggatccagaaattttgctttataggatcaatataataaaaaaatgaaggagccacatgtagaaaaagaaaataataataataataataatattattttaaaaaataaaaattataaaaaatgatgatgtgtaatatcttaaatattctttataataaaatattataaaggagtatcgtgcgtactgttcatcgcatgatggacagctacagtggtcacgcgtggacatgcatttagagcgcacaatcccacgagatcccatgcagccattcattgtgcgatggacaatgcatgctatcacaacaaatgatgcgtgctcttaactacaacagatggatggatgaaattgaaataatgtattaaaagataaataaaaaaataattaataaaaaaaagagagaagaagagagagaaatcaaattgatgtgagagaagaagacggagagagtgataggatatataagtcattaattaaaaagagagaatgtatatcataattatttctttgattgatacgatctttttttattctttatttcttcaaaatattgtatgaaatataggatcaattcataaaattagtaagatcaattttagtttttcacactaacatacatgcataccaaatatttttttttttttttatgtatggggtcaattgaccccacattcaaccacatgcatccgccaatgtgttgaagaaacaaatcaagggaactgtgcatcagaagtagacccagactccagacattggaaataaatgcatgaaactggagaattgaatttgatattttctttgttttggagaaaaaatactatagtcattttcaccttccccacaaactgcgaccaaccattacagcattttcagggatttgtaaactctatcctgctaatttacatggcatcccaatcttgttttcagcatacagattcttttgtacaaaaatgagaaaaattagtgcctgttcgcagatattcaattgacgcacacaatcaagacagctatgcttttaccactttgggtgcaagaacctttgccatcagtccactcaagctgcacaatatgcacatgcattctgcgctctgtaattcatctgctgatgtgaaaaataccttcaacagcaaactgaactgtgaattactctagagatctgcataaattctttggtcatcatgcttctacttctggattcatttctctccactttaacaagtcctcttattcatgaggcattcaacaaaatcatctcactccttctcagcaatgacaacaaaaacatccttacaagaccatttacatagtagacttttgtctggtggattgataatcgcttgctcagcatttgcaagacggtacccaattacaatttctttcctctgtctggcacgcaccattatttcataaaaattcatctcttcctcctcatgaaggtacagatcagctggtcgtatctgcaattcatttccctgttccaaaggtgtttaggtgcacaatacagttgagaagcatgcaagagaatatcaataagaaatgtggactacttagcttggttcagtatcaattagatgaatctatcaaaataaagcactcaaatacatatgcttagggcagttttagctattggttcgctatggtgacttaacaatcataagaaaggctggtctggatgtttcattttcttttctttgcaggaaggtgtgctggttttgtatgttggaagttggaacaaataatgtgataatgtactgagaaatgggattattcagcataagaataatatatcacaagttgtttctgcattgcaaattgacacaaaattttacatgcattattggagtgatgctattctaattgctcaaaatttatcaatcaaatgccttcacatgctttgggtggttcttctcctagaagtttatatcatacatcccatttttgaactcctagatcattgggctttgttagctttgtccactctactggtccaaaacgtgacaagttagatgcaaggcctagaaacaccaatgttccatgggctcctgtacagcaatattttactggttattttcctggaactcatttacaattagtttgtgtccacattactgttgtttatactttatatctttcaccctttgttttcttcaggcatgcgttgcgggttagacttattcatatctagttagctgattcaatttctaattctttacctactcttctctgtatcatatttgattcttcattataccttttatggaacaagttagaagctctcattaaacattttttgtgacaatggaaatcagggtacttaatgcatcttgaaatttatactcatacaagcttaactcatgtatccgagaaggttggtcttccttgctgccaacaaaccttcgaggttcatggcaagccccttaccttaaaatgccttggcagacttataagatgcctggttaagaaatcttcacaactatctcatacttcaactagttggttagggtttcatgcctccttaagagccttcctttgggggcactctgtctgtagaagaaatggagcccaaaaggagttacaaaaaaaaaaaaaaagctttcaaggatggtagttggatctcaaacctaaatccaaaggtgagataagcctgatcctttacagcatttattcttgataaaacatcatctaacccttctatatgtcattttagcttctcaaatacatttcatttactgtaacctgattctcaaggttagcacctcttagaaagaaagaagaagaaagatccaaaagtgttaaagcccattgagttctacttgtgatttgatgatcttatttgactaccatatttgtaaataaagcaacatcaactgtataatgaaatatcattgccagactcttaaattgacacaaatctcacataagttgacatttaaagttttaaaccatggcaaaaaatgaagctaataataaagaatgcaacccatgctgcgtccaagagctaaagagtacgaagcaggcacttcatagaaaatacataaaaattttcatttatgaaaaattgaaaaccctttcatgaactttgtcattttaagttccaatgtctatatgatctagcatctactgaacatttagttatacagttccttaacaaatactgggaaaatctacgatgtcatgcaaatcatcatcaaagaacatggctgtcgaccaagcatgtgtgcctgtttgagcctgcatatgtatctattatagataccatttaaacacaaaagttaagttcctgagttactgcaactagaccagcagacgtttcagtttcatgcaacatgatgttatatcaagctagtcatattcatttgaacttggagaatgacagccacaagaatagctattttcacaatatcagcaagtaattttttgccattatattgaaaatatctatttaaaggaaactaagcaatctagttcttctatcataatatcatctgaaaatgattgtacctcttctgcaaaaagctcttccaacacatcatttatttgccggtcttccgcaaccattgctaatgccatgctcaccaattcatttgataagacataatcactaatttttgacatggacaataaattcttcgtcctaggatccagaatttcactgattatgacagacttatcggatgcttgctgcatttctccaatccaagaaccttgggagaaacttccttggtgaacatgggagaccatagcttccttataaggaagtcgctttgcctacaacaattatttcaaagtatgtttatcttgaaattcaagatttacatatctaactgcagaataatatctgagaaattctagagctttttccaccgaacaactaatgatattaatatatagttgcagtggcaatcaaactctaaggcagacagatttttgacaaaagttctatttctgaaattcatccacaaatattcataaacaactcgttctattttattgtaacctgttatacaacaaatactatcaatacaattgactgcaagtgtcctatttttactgtttccatgtcttttatgaacaatttaactttttttaaaaaacctttgaaaactaagaaagtaacattagcttgattggtacaaacttcatgggcatgtgtaaagattaaggtaaatatgtcatatgtgtttttatttttgcgacttgaagttttagatatataatcaaatattagaagacaagacgaaaggggaaccagagacagacctgcacagatatacacttgtatgcatgtatgtatatatgcatatgcctatgtatacaagtcattgcttggatgcttatattaaaagaagaaactaaaaggaggagaggggaagagagagaagtatgccatctaacaaataaaaataatagaatagccctgataatgcatgtatctatttctacaagtcattgcttggatgcttatattaaaaaaagaaactaaaaggggagggggaagagagagaagtacactatctaatgaataaaaatagtagaatagccctgacattagtttgcaagttgtttaagttattcattaggtccatttcaggttacttaagatgtgataggacacctaaatggataactaaaagtgatggctttacactaaaacatgatgagactttgcttaaattgtctcataaccaagatgacttatattaaaaacgtaataacactttggataaagtgttcagcacttgaaacagagagtctgttgcataaaactacaaaaaaaaaaaaaaccaactagtcagcacttttttgctgatgtcagcaggatacttagatgaatgtccagctatctcatgtcatcctaccttgtccaagtgtctaaaagtgccaactgccaacacttccagaaaccttaaaatgaagtgtccaagtaacataacaaatgatggtactgcagaagaatatctgctgcttcacatggcacaccagaacatttctagacttaagcacagaacagaactgcagaaaaccaacaaagtggaaaggggcatatgaagaaatcatgcatattttgcaaaatgaaccgcttggaaaaggtataccaatcaaaagaaggcaacactactttattatcctttataacatgcagagtgatgacaaagagcagtctttaagaaatatattcaaacaaaagagaattcccaccaaaagctaattgaaattcaattgtgaacctgaatatctctgattagcagtaacgttgcaagagatcttgaatcagcttgcattgcagagtcttccacagattcatcggccaaaatcaaaatctgcatgatgtttttcgcagatgagattaattcaatatactgaactaccaatcatgaaagattatagatattccacctaagatttaaaattagcagtttaatgcacaaactgattcaagtaacttacagaatcaaatgattctagaggcagactctccaagtgccggcggatgacagcatttccttcacggttgaccagagttatgttttctaatcgactgaagtccaaaccaccatcaattagctttttttccctctcactctcagccacatcattgaacatccacaattctgatcctggtgcaagaaaagcatccaacacctgaaacagtgtattttaagattgaattaatgctggaatttgtttttgtataacatcttcaaccttcaagtaacctgcaataatttatattgtgataaccaagcctatattagctggaagaagcaccatgtagttcaaatccgctaatataaagaaacttgaatagaaagtcaaagtaatttagctttatttttaaacattttcaattttttaacgtgatttttattgttggtctaagggaactatttggagtaggttaaatgtataaagatttactttacgtatatattgggttattggaggtcataaaaaatcgatagatttaattttacaaagcttacatggttacctattatttctgtcagttatgaggagttctggatgtttgtaattcatacaagcttttaaggaaaatgaagaacagcacaatacagcccaatagttggcatcaaaatagtagagacactaccttatcagcatatcatggaatttagtcagcccagggttgattttgccacatttgtgtcaactcatatgttaagaagctcagatagctgagttcccactagcaataagccagaaaatctacaagtagcaatttcactaatggcaggaaagcagcacttttgattttcagcgagtgaaaaatgtatttttttaaaaagaatacaagaaacaaattaaacacaatgatctcaaagagaacttttggaagatacgctgacacatggataaaactttctctgtaaatcaaatgggaaaaaaggaacagaagaaagatatacaatggcaataaaagaagaaagcattcaggaatctgcaataagaaaacaagcttgtcctcaatgaatcttacataagacatgctgaacatgtcaagtgcattgtacaaaagattatcatgatcatttatgcaaagaatataatatattatgggtgaattttgtttttagttgctcagaggatctagtatctctatgtaactgagtttttttcttggttgttctgagtagtcagcaaaacatgccctttatctgacactgactcaaaatgtttcctgatctagggtaagcaaactcccaggtaaccactgagacacctatgaccacataattcaaataaacaatggtgcaagcatcatattgaattcctcataaagttaccataatcatatcttccatatctcgccgccaaccacaaaaaagtatcctttccggagactttggaacaataaaatctttgggaagatatcctctatggacctgcataattaataaaaggagagggtattaggggcttcgaagtaagaacttaccactatcatgtcatctatatcccgtcgccatccacaaagtaaaatcttctggggctttcttgtgggccggacaatgtctatgtatactgcatctttgacctgaatgataaaattgattatgcttttgtaagttctagtagtggtatattttatgttatttatagtttcagtcggatcaaattgacatgagcaaattatagaatggagaagccaggttgccctctgtttatttttctttcttggtcaaacttgataatagatcttaatgacttaatcttttttcttgcaatcttggatccctattagtacaagaaatccttttggcatatgcattccttaggcatgtagttcaggacctcattatgcacaaaagcaaaaaaaagtatgcgtgaaattcagttagaatgcaactgcaccattgaatgtaggaggaacacatattcctggttcactagttttcaactatcctggttggaaaataaagtgtgaaaacttctcctacagctaatatgggtcatagatccacgtagtcagagttacataaaatatgtgcacatatagattgagatgaaggaattttgcacaacaaaccatgaacaatggttgggaatagaggatggaagtaatcagattaggttatttggggacaaaaatactatcccaactcccaaggatttgtttgatcttcattttgtactacagaaagaataatatggattcaacaaaaatgactaaaggcagaggattcagtgcagatgaatcttggcagtgttatacatttgtaatttataactgcattatattttcataaatcaataacaagccagcttaatgaaatgaactagaatgttgaggcaacgatgagggcccatgagcatataaagttagaagaaaagtcaaggatatcgagatgaatgcatgcacttatactaggagagagtgttggaaacaagtgcaatggaggaaacttaggagccaaccaatcaagacagtttggacaagtgcagcaataacagctccagccagatgggacctcttaatataggttgaatctcgatggagaaccacatcaacacatcgatggggtagtcaagaaaactgcagttcaaatgtactggttatataaaggaaccattgctaaagtaggatccaaacaaatgcctcatatttataggaaaagtgtcttgtttagggctttgcttaccgaatcaattaagatttcataatgccaccatttgccatttcaaaaaggatggtgaatttaatcgacatttaattattcttcttgaggggattgattctaaatcaataaactaaaattagctacaaccctcaaaaacaacaaaaattacagatgtgaagagaccagagcaaatctagtaaagtcatcaccaacatatatacatatttatgtatatggtcccttcgaatgccttctagaaactgtctttggtcatggatttcaacacctaaatgctaagaatgaacgaatggtggtggttgggaaggctattcatgccatgccacttgaaacatatcccattggttcttctaaaatgatggttaatacactataaagctcaaagtctacagtatatttttaaatgaatccggattagaaatttagtttccgcttcatacagactagagactattgtcatgtcggggttagtgctttaacaagataccattttgggccaggaaccagcggggaatagactggtgcgtgttacttttttttttttggtacatgcgggtggtcacatcactgatactatttttcatccgagaaatttcccaccattttagcttccttctacttgatcatgcatgcagacttccaggagtcaaaaatcccagctaatcaaaggcattgcatttgcgggagcaaggtaattattcatatgcaatataagaccataagaatgtatagataaaagatgaacatataacagcagttcaccttacctacttgacagttcatctatctgacaattcattgcacagtaccccctcgacatgagggccaaggtagccaattcagctcccatcacatccaatagagagttaatgagacagtaagaccgagtcagataatcaagcacctgccataatgtcttcttctcaagtgatttttatatgttctactgctcttgtatcaagtcaatgggattgatattgaattttatttcttttcactaagtagttaacttagttgtcctcccaattttaatacagtacattctaaaaagagaatcccgcttcctaagatcgattgcccaaaagcatagcatgacttagatgttaaggtgtccagagaaatctgccatgacatccttgaaacaaaaaacaatagtagtaacagatggaagcatggatgaatgtatgtgcacaatataaaacaaattgaatcaactgccatcacatgttagacctgacatatgctagatgtgctggatgcctccatattatcatgtaatcatggtcggtcagtgtgaaaagagaattgcaatgccatgtcaccatttgcaacttcaatagcccattacagtggtgcatttaaaggaatcaagctaaatttgatcatgtcatataacaattatacaaatcagtaatcctctgttaacagttagtaataaaccaacctgccataatatgtatacttgtgatctgtgaggtaagcacattgtagattaaatgcacaggcaagtacaatgatactgttagagactcgaaatgatattgtagaaggtatgcacagtcagctattgtctttagtttcctttgctagaaagaaggaaaattaagtagcatagattaagaggtcaacttagaacaaaaattaacatagattaagagatgaacttaaccatctacaaaagttctgcacagtaagtgaatattgctagacctcctaaacaatgacaacattgaaaagaactgattatgaccaagttaataaacaattaaggtcccagggaaggaaatcttgaatattaaacctatgcacagatacataacattggaaatcaaatggatgaatgggagcatatgcaatagcctgatgaagaggcaataatgtcatgcattcctgaagctagggattgttgcataatctaaactccagcaaaatttctggcagaaaaaaaaatgacagaatagctaatgagcaatcaaagatgacttgaaacatttctatcaaggtactgattatctaaaaaggaaaaggaattcaccataggcaatgtagttggggcataactatcatcatcttctgcaattacaagtatttcatcaccctcctgaagaacataggaatcatcaggattcaaaatgatctttcctccagaagatgccacttttattccacaaggtatggcatcaggaaagctgatcaatacatcttcaaattgcattccatccaactcgggccatcttttgatgtaaaactcacagttttcaaacccaaggatatcttcccagatctgtcaaaagctattaaatgctaagtctagggaaaataaacacaatcaaccaaaaacaaaatgatatcttttgttcattaaagtaaaacaaatccgaccttaaaactacacttatgattagatcactacatattaatttcaatatcaagacttgattcatttgattcgccttgtatgggcccactttttcattgccttaatcgagaaaggcaaagagatacatcaatgttacatctcagatagacaaaaagctatgatgtttacatgcacatgaaacgttgttaataactgctcaagcaagataatgacatcttgaaaatgcacatggcaaaagttctcttcttctcttcctaaatctgaaagaagactactattttgcaatttctaactcatgagactacccacaaaaaggtatgtaagagaatagtatattgatatttagcttcataatgagtgacactaggaacaaacaatccaatccagatgcctacacttgtaagctgaatgttcaagttagaagagcaactgtgaacagcattattatgcgagtcagacaactatgatggcaaaagaaggcaaagaagaaactaagaatacgaaaaacacaactcaatggatcaggttcagaatatttggtaagcatgagaaggtgggggcaaaaacaaaaccttgcttaaaaggagaccaaggaaagcaagaaaagagcgagagacagcatactggaatccgaaacagcactaacctaagcttgatcgagagaataagtgtaaactggaaagtataacagaaaactcaaagcccaaaaagacaaataaacagaaaaacaatgctacagaagttcaaaaaaaaacattaatattgcaaaataaaaatagaagaggggattcttcaataagagaggatttggctagaaatatatatcctatcgatgaggaagttgtccatgactcaagattatacatctgctgttatgaagagcaatctctgttctgcttcaaatttattcttacagtcaattttttaccagcaacgtaagctctctaggtttgtgagtggacccaaatatttttctgttttccatgatattaattccgaaggggatgactgcatccagaggatgcattagctaagcaggaagaccacccagcaaatgcaaggaaatccaaccacaacaaagaaaaaacacaaacgaagttgcttgtcaaaaaaagacaggaaaaaagcaactatgtcacatgatctgaaattgacctgagcaagacctggttgacgagcacactgtatcataaggcgaccaatcacatcatgagcaacaacagtttcaacaagatctccaccaactagcttaactaggacttcattatcaagatcactcaattctaccactatatgtccacttagtccttctttaactccagtcaagcttaaaacagttcgcagtgcccgtgcgtcgctctgtaataaatcagcaggtgaaagaatgataagtaactcttctgacataaaatttcgcaaattcaaaggtattgccaaaaggcccaaaacagtacctggtccgcatttccatcttcagctaggaccaccactgcacgagccttcgaaacagaaacctgttcaacaacagacacttgattcagcaaacaactatttgtagcagaaaatgaaaatcattaatcagcataataaatttcaattaagtgtagtcatattgttgtaaaggaaaaaatatcagcaaatgttgaaatagatgatagaaattgaggtcaagactttaaaaaaaaataggtagacctttttcagatcagcaagaattagaggacttccacttctgcatatgacagatgttcccttgaagtcaaactccattttggcaatatctagttccatttcctccttgtccctctcagccatcactactacagtgcccccacccaaactctcattggctattgaaagttgattcagtaaagaaccctgctctcccattagaagcattaaattatgagaatagcaatgttagcagatatacatacaaatgccataagctaaaaattttatttacagcttaagcacaaaaattcaaccatcaaatgtcatatgaatgccttgcacatagactttaaataaaaattcaaaagatccaaatcatatcttttaagaagaaagatgcgaaaatcttaaactatcgttcctggaaaatagctatatagtcatctgtaacaaccacatgcaggggcaaaatctcaatgccatagagaagcgaaaagcatattgtcggaaatatttcggtacattgtaaaaggtttggtgggttggacttctgattaactgaatcatttcttgtaggtttctggccacagtgcatggttcgtgaataatagagatcataaaatgaagtaaatgacactgcaaaagattccataataaacatatagaaacacgatcatatagatacttgtcaataaataagcagatcacttataaatgaaaatactgattctaaaaagtctactaacacgtagggaaaaaaagatgctgttgctgtattagtttcaactaggtgattttgtccaaaaaatcacagtattagtttcaattcagttatgttacttaatccaaaaaatttacatcctgttttaaccaccattttatatgtgtaatttctctgcactcaaaatatttttctgcaaatttatataccagcctaacagtataatcttttgataccagtataatcttttgaaaggatttttactagaataatggttgtcaaagattgctttttaagtataaaacgttccttcaaaaaaatgcattggccaaaagataactagtctactttaattgaacgacattcagggctgaatttagctaggagtcccagcatagtgtcgtgcatggataaaatagaaccaataaaactgtcaaacttcttgaaatcatgtaaagtaaccaaagagccttacttcgctttagaaacagaacagaaggaaggaaaggagtgcagaaatatgagaataaatcctctattgccacctcactattcttgtgcagaaatatgaaaataaatccagaaatatgagaaatatccaaataagccacctcacttcaaaaacagcacaggaaggatagtgaaaggggtgcacaggaatgaaaaagaacctttatctgttcattaattcattcactaattacatttacgtggagattgtgagtggccctcaattaggtgaaaaatttatggtggatcaaagggttagaaatcagaagaggagaattaagaaaacctaaacgtaaataaaagaattacaatcttcattagctgaggatgtcgacttactgaggtttagaatgcacagatagcatcataattaatgattcaaatggcttgggcaaggcacattagttgtggtcgtggtttcccgaggcacatcagttagggtcatggttttcctaagatttgtgagagaaagaagagggaatgatgtttgattggttagttacttcctaatatcatcaaacaaagcatgcataatagttttgctcccagattcttgacagcattcaagcatttgtttctcagcatgcagatgctgagccaaacttcatgttgcacggaacatgtactttaccagatgtttgcaacaaaaaaaaagttgaaattagaaaaaatcactcacatcaatgatttttctcatccacgggaaccctgaactactgcttctctctctctctgtgtgcgcgcgcacacgcgcgcccaatttctagtgaactttcttgtttcagaatgctggtatattgtttaagaactagtaagattgcttttaacattgctcatgacaagaatttcataaattcttttggctctcaaagtaatttaaactctacagaaaatgaaacagatggttgatgtatgatgtttcagaggactgtcagtagtacttagtacttactaaagaagggaaaataactatataaaagatgcaagaaaagtaaaatccaaatttaccaacttatcactccagccaaggattagtgtgtgatttttctctatgacttcacttctgcccttcctcaatgaatcaaacttctcagagattgtgtcagagacaagcccaagcatcatggcaaatattaacattccaccaaaactgatagaaactgaaactaacttggggctaataccaactgaatttgcatgattacccgaatcagcaacataagtccacgataaccacagacagtctgctaagctatcatctgtcacaccaaagagtgccagaccaccaagacatataagaagaaaagttgcaagaaataaagccaatggcttagcatatggttgcaccgacaaaaatacatcaactcggtatgctaactccttgctaagagaaacctcctcagtatccgcaggcatccttaaccttgaaatgttgtcaaggtgtttaaaagtaatgagtgggatggacagcacagcaagtgaaaataacagagcaaaattttttagtcttctatttagtatatgatcactctcttctggtacaatgccactgctttccagcggatgaaatacatcacatgcctgtagtcttgcattgagcatggagagctggtcctgtaaaacaaaaacataacaagtaaaaactattctatgaatagaccaaatacattttcgcatctatatattttttttcatactggataacaatcaggtgtaagaatgacatctatggaagttacctaaataaatcttagaaaataataagcttccttttcctgtgggaaaatgattcatgaaaacatgcaagcacaagaatgattccatttatagtattgaatagaggcaatttaagtacatcacaaattcataatgcatttgttcaaaaaattatacatgattcctttgttcagttgaacagatgcaaataatgtttggtgccaatttgcttgctggaatagcgcatgccgactgggacaatgagattaacattgcaaatccttcattttgaactctctatcagaaaatttgaggatgggcagattaaactgaatacagatggctctctcttgttattgcttcaggatatggtgggtttcaatgtgatcataaaagtgatattgttttaggtttcatgcctcctctccttctacaacatattcacaagttaaaagaagcacttgctgatccaaagtaatgctctttgccaggcatttctgattcttacatacaatcagagtttttctttcctttctttctttcttttttcctttttttttttgagtataattgtgaaagcattagaacaactgaagccaaatacttggaaccaacactgtgaagatttgaatctagaatctccccctgcatgaaggaggtgtgcaactactacacagtgcttgcataagtttggagatgaacttgagaattccatggaatacattggccaaagtacaagcccatgtgagatgctgagtgcaccatctcaaatatggtaattgatttgtggaaagcataagttccaaatcagtcatctttggagagaggaaaacagatttgtatattttcttgcaggaaactaatgcgcctgttgcggatttgaaatatcatgtggttgaacccccatttttccacataacaattaagctgaaggaaatcttggatgaggttaatgatgctatacatactggctttaacaagagttgtgcttatcctttttagcatcactgatattttaagaaagtgttttttaaaaaaatgtatttataactgaacgattgatgctccacatatttgcacttagactacagccatctaaaaaagggggagagaaaatctggattatggttttccagaatgtaagaaccatggcaacaatctagaggccagaaagtgaagctaattattggtatcagccaattccatatcaaatcatcatggaaagggaatgcaagaacatccaagttcacaaaaacacaacaatatattgatgcaagtaaaacatcaagatttcatattccttgatatccatcaaagccatgaggatccatcatgacatatctatttcagttgttatggcaattaatcatatttgataaactagacataaggaacatagcccgtagatgttgttactttacctgcaaacctataatttgattatgtaatgaaaagttcttgtgaagaagagaagtgaagcaggtgacgataatctgcaagaaaccaagttgcatataaaacaacataaatagacttgaaaatactgcattcaacatatatttggcaaatgatgaaaaatcatatgctctcagcatggttaggagattaatcaatccagcataattcactctccactagatcacatgaaaagttgttatgagttgaaccatagttttgagacactgaatattcaataaattctgcaacatgcacaaaattctgcagataattttaagaaaaaaggagtgaattttaggacatgttattgagtcatcgactctgggaaaatagaaactaaacattagcatattcggtaccatctccgcagaactttaaaaaaaccagaaaagtggctatttttgttggaactaccaatattttaggttcatgatcaaacaataactgtgccatgcattagattttcccacagataagaaacaaaaaaatctcaaatgatttccccacgtcccaagaaatccaacagcacagatcaaatttctgggtccattatacctaacaaatactggaatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctaggcctcggttctcgcatgaatcattgaacccttacaaaacgcgcgggaaagggagggagggagggagggaaagagagatggaaatggaaatcgaaatggtagagccgaccgagggctggggaggaggaggagcggaagctgtgcgtagcctggccgcgggatcctcgatctccgtacgctaccactctctcttcggatctcatgatgatatgctccttctcgaggtcgatgagaagctcctccacgatgttctccaccaccggtaaatctttactgtctcctctctcaacgcttctcatcacgttaaggctctttttgttgttatctttttaatcctaatctcctgtagatcttaattacttgatatgggtttgttcccctttttctaaggtttgaaggccctcattttttagttagggttctggaaattgagtctttcatgttctctttgaaaagatgacggatgtgaaattcgattaattgacatctggcccaagatgtctgctgatcgattcgatactcttttttctgaggttaatcgaagccgagaatgtgttgaattgagcttgtgggtcacatgcttgtggcatttctcagttgcaaagaaaacccatccgactgtctaaaaaagcctttcttttttgccaggttattttacatcgtctttgaaacctatatacttaattgtttagatatgtttgatgattaatttttgacgtttggactaactatttaccgctgaaatgacatggaagggattattcatttttagcttttctctcagattttggattttgaggatcatttgtcgtgcctttccacatgcactaattcaaagtttttcatcattctgatgataggatttttttccccccagtgccaatcaagtctgtccttacctttttggttcactaaaggttttgtttatttaggcagtttttccttgttcatttatagacacggctctaacaacaaataggtacatagattttgatttgttaattttagggattgggcatcatccaagaaaattaaaatttgtttgtgattctcatgaaaatgatggtctgcgagctggcctgttggccataagtatctaaggctttcataagtcacccgcattactgggcaaaggaagtaccatatatggcctgttcttttgtggataaaaaatttatctgaaaatctatattttcctaggtaagtattttttagataatatttagatagaaaaataattatccatgttcttttatgtatagaaaagtggcttcaaaatctgttacctatgttcttttgcattaatacttttctgagtaagttgctaaaatttatccatatttttcataatatcctttatgttttttagttttaaaaaaagtcgatgatcgagttgttgggcattgaatgatggaggtattagatgagaatggggcattttaagaataaaattaaatatctactttactgcctgataggaaaatgatttagccatctcttaggtgggtaagatttttctcccatttcatgaataaatgctatccatggaaagtaacttacccatcttgaaaagcatgagaacatgggtaagttggtcaatgggaaagttgatcaatattttcatgatatttactcacaaaagaataggcccttaagataactgggagaggtttagccaaaagaacattaaaactcgtgtgaatatgattcacactctacacaataattgtgtcaagacttcatctttggcttggatgctatcatgatcaagtgacacctacacacacacacatatacatatatatgtatatgtgtgtgtgtgtgtctatatatatatacacacacacacacatacatacatatacacatacatacatacatgtacacatacatacatatacacatacatacatacatatacacatatatacatacatacatatatagatatacatacatatatatatatatacatagatacagatactagagaaatagttgactcatcagggaaaaaataacatgggagatttgaagtgagctttcactttctaaacatgtgtattgaactatgatactagagaaatagttgactcatcagggactgtctttcaatttgtttttctagtgaattataatgcgttctataacacattgtgcatttttctccaaatttagttcatgtgtatttttctccaaatttagttcatgtatatcaaggttcgctatctcggtaccaaatctcgtatcagtatcattctattacagtgttggtgcatagtatagtatgagacagtgagatatattgaatgttaatacaatatgagactacgtaccaatttggtgctggtgtggtatggtacatcaggtgcggtatgatgcggatcggtgcaacaaaccttgatgtatatagataggaaacaaaaggtacataagtgtactgctgagcctaaaaatgggagagattggtcctaaagatatgggaaatatctaaaaggctagcaagaagtatatcttaagttggaatggtctcacagcaacaatttctccccaccaaaacagagacatgtcttggctagaaccagaatggtaatgcagaccttagtgtaaccagaataacaaacaagaaaggaaaatttagatgtaagaactcagcaaaaggagatggaccccatcaaaataaccaacgtcaaacatgatactcctgctccttctgctcaaatatataagcatccgactgctggatagcctagcctgaacccatgttccttcgtattttcatgagtttaaactgcataacaagatgtttgatatccctttataccaagtggttggccctttaggtatcatgacatgctcctatcctgttccaagataaattggtaaaaaaaaagaaaagcaccaatttgagggttaatgtcatgttaagtgcttgttaaatgtccggaatctttggtggattatgacttgatccttaaagctgacctcataggtaggacagcacttgttggttatgctacacggcttcaatgagctttaatctttttaaagttttccccaccatgacacttcaacatcatcttgcaagtaccatatcttggtgtccctaaccatttatttgattttactttttcaatatggcaagatgcttttatttgacaatttttttcaccaatctactttgtggttaaatctattaacttcttgcatacttactaggcaactaagtgctttttttttaaaattattcttttaaattgcaattacctgattttcctttattaagggtgaccattcgagggcaacctgatgaggaagctgtgctttgcactccttcttcaacctatgccatgaagtttgttggcacatccaactctgtattattgatacctgcaggagagccaactccttcaagttcaaatggcacatgcaatggtagcgagacaaacaacaaagcagtccctgatgcagtggcatctgtcatcaaagtggcaccagggtatatggagctaacccaagcagcccccaggcttgataaattgaaatctctccttaatgagagaccatacagacttgaggaagatctagaaaatgatgtatggttcaagagaggcctgtacagatggcaagatctggttgaggagattcaggctagtgatcaggagctgagggatggattgaggtccctctcggctgttgaggttgatgggtactggaggatagttgatgggaaaacaatggatgaaatattaaacatgatcttgaccaactccgtcttgcatgaatggcctctaaatgcactttcagaaaatgaagtggtatcaatcttagaagctgatgggttccctggcagaatcgtactccactgccttgaaacatttggaagcaaggtggagaattcaggaagcaatttgtggagcttagatgaaaagcgggtctgtttgcattttgctgtacaaattttgggtggtgggaagatgaagctggagattttcatggcaaagtggatgcgaagcattccttcaggaatgcatggagacttaaaaatgcttgaaggggaagtgctgtatgaaaagcttggtgtagaaaactggatccatgctttcagtgtctcggatcttccatcaactccagctgagcgtttcgcagcactgttccgagagcggctgaagtgggaatggaaagatttggagccctatatcaggttgctatggctccttaccaagttttcatcgggttgcttctcctgtttaaattttggcatctactcttattttcttgggagcctgacaaaactttatctttttatagggacttgcatgttccgggcctctcctctgaaggtttgcttatcaagtatactcgaagaacacaaccaaatgcagatgttgaaccaattttcagtgcgagatagtcttaggtagtcatatggacctgttttcagcttcttttgcctcaggtaaaaagtgcatcttcagcttctctcagctgttgtaactgttttcgagtccatttttttttaaaaaaaaacctgtttttggagattcgtgtgttttagcaacatctctatttgattatattgctgttggcagaataacttattgttatctttttaaattgatatggggatttgattttgaaaaaatattctagtaagatgaacaataaaagtcaaataatggttgttgttgctgttatgcgcactggtcatcagacacaacagcaaattctctgccaacgagatgtctggttgattaggcattcatcttttcactccttacatggtgaactgtgagaaaagaaatccaaagaaaaagaagaaaagggaagaagaatgtgggagaggagataagggtgttatgtgattgagcttgatcaagtctaggtctgatcaagctggttgaaaattattttcgggcctgaattttgatatcaagctaaatttatacgttatttaattaagtctaatatgaacttgatttcaaaccaagccaaaaacaaatgtaatcaactagcttaattatacaaagtaagacgaaatcagcttaggaattaaacttgattcaagcttaaattggcttctaactgatccatacaattgatgtttaatcataaagagtcaatagaaaatcatagctgttgtttcatagtgagttaatcttagcattgaaaaaaaaaaaaatctaaatttaatatgaatactagttttctaatttaacatcgattctactgatttttatctgataagaacatacctatatattggaagtttttaataaatcctataggcttttgagtctccctccgtagctctcctatctcttgtgggtttggaccctttgaggtgtgtgttttgcactatagggactgtatagtcctaaatggccactacatcatctgtcttgaagatggatgactatagttccatctgtggaaccaaaggtggcatgtttggtggcaaatatgtgtgtgttgaatgacagcaatccatctccgagatggatcgtttgatagctattcaggactgaatagttctcatggctgatgatcctgactcaaccctcagttttcaattttttgataagcgttgcactgtaatgcaaagatgtggagccaccaaaactctcccaacggggattcctgctaccaagcaccaccatactcactgctccagtcagcaacccacctaggatggcacgagggaattcgtgcaattaatggggtgatccgccaatctggcgctgcctactatttttcccagtcaaatactcttagagtccaagtcctctcatgccaaaagccatcttgtaacggctatactgctagtgtgaagcacgggttagccgttgctctcactcgtccccaacggtcacactcgagcccagtctaggctccagcccttcaaataagacctctgcctccgctactctcaccaacctctctctctctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagactgtaagaaaatatttctaccaaaatgtgcaaactggttgatgctaaaacaaacagaagatgaattccagtttctgccgacattttaatcgacataatgccgtcaagaagcccacataaaaatccaagctcgctttgcatgtagattgtagtgtcaagtgcttaccaaagaccaatattttccaaatattacaaccacgctcatgttgatggtttattacaaccactaaccccaaacaagcaacaaaatccaacatagcatcacttcaatcaactgttttttttttcttcttcttcttttggatggtcacgaacaaacgaaagccaaataaaagggtaagtaacaacagaagttaaatcaagcaatcaaataccacacctacacttgctatttgaacggccttcttccaacgccggcgggcaaagagacggtggagtcgacgctcaaccctccgaccgagaacgtcttcttgtgcttccctgccgtgcccatcctctgcgacccggcgtccttggccaccgagaagggcgacccgcctttgctccaccgcagcgacccgatgctctggccgagcccgaacgagaagcggcgcttgccctcgtgatccgcggccaagaagctgcggactttcgccttggcggaggcggtgggggtcatgtagttgggcagcgtgtaggccgggcagctggtgaggctatcgtcgtcccggaggccggcggaggaggggtggtggtccgagcggcgggaggaggtggagagggaggttttgagcttggatgcggaggcggggcgaggggtgccgcggctgagagggcgcggataggggtgggcggaggaggaagagggggtgatgggggttcgagggatggggatggggcgagaggccggggtttcgggatgcgggtcgggggagaggcggcgttcgaggtagttccaccaccaggggaagccacccgagcggagatcggtcaggacggcgtgggccgactggggcgacactttgaatagctggggtcaatgaaaccagttggtagcgaacgtttagattgggctcaattctacaagctcaaattattgatcagcggtagacctaattatgggccgggctcggacctaaaaatattaaattttatataggcaatagagtttggtatccgaagtccggcccatgatcagctctaatcaatggtaagtgtaaataatgatgataagatgttatattttttctcattcgggtttaaccatggctgctatatatgtattgcacgatagctattaaaaagccttatgaaatatataacacatatagatgtgccaacaatggtggcaatcagatcggtcggacaagacataggttaggtcagatgtatgatggattaaaaattcattaattcaaatccgatctatctatcaaacagatcaaaaatatagatctagatcaaaatattttattgaagaaatagtctagcttaatcgacgatggtttgaaataaattaaatgaatcaaacggttaagcattgccacccgtgtttgccataggaaaaaaattaggaaatagcgggcatggcatttgacttgagttaataggctcctcttatctgccaatggagttataacatatcaactcctaaagctagtttttatatcagacatgcatatctcatgactattaagcctgtgcattataacaggaggatgtctacttaatttccacctaaaatttggctaccatagaatacctatagaagaatgaaggtaatgactgaaaactcaaaaggctagatccatggcctctagtgcttcatttcaagtatttaattcaacattaatttgattctaccaggaagtgagggattatacctgatgagagtaagcataggccagagctctttccctcttgatgagtgcctccacctttcttcgcattcttgcatcaacctcctccttcgttagcatgctatcatcccactcctcatggcctcctgcctctgactgcagaacatacagcatcagttaggtccagattcaaagatcacttccaaacaggagcaaagatatgatcacagaaccatattataattgtcagcttagcatgtaactttgtcaatgttatacttcagctagaatcttttaaatagccaaataacaaattgagcaagcttgacctttcttcttcttcttcttcttcttctttttgttgaatagaaaggtgtaaattatatacagtgacaaatagaaagctcaggtattcagtttctcacacctggtgagttatgctccatttgccaaagctgctttcaaattccttgtcactctttcgtggggtctggtgctgttggatactcctgctttccatcatctgcagcctcctcgtacgtatttgtgattggactcttacaagcatctgcatgcatttcattgcgttcacggtctgacgcttcacactctgccctctcatcacaccttgaagtcttatcaatccttttaatgctcggtagttccttctagccttcaccatcaaagccaaacttataacagttctcttcattgcacattaattgagatcatgtgctgaatttgatagctaaatcgcttgtagattatggttatgtgtgtaattgaaacttggtcaaaaactagtccatgagactctttttcagtgatgctaaagtgcctaatgttatcattgcacatggaaaatagcacaacatgcaagatttcgttacataggtaccatccctataagctgtcaagaaataaaaaagtgcccattctgtaaactaaccattcgttcattctcttgagagttatattggacaagaatattggatctatccatacaactcccaaaatggcctcttcacatcattgtatacatttactcatcatcaaaatcatcatgatgtgaaaaatctaaatctagcatgatctcttccttaattttcagtactgcatatcattcagcatgttttgacttatggcaaggaggtttgaatgcaaaacaacctattgtgaaccttctctaactgttcaataaatagtttatatagaagacttgatggatgtatgttatttctaatgtctatcacataatcatacacttcgtgattgtgagcatgcatgtaattatattttgaagaatgtatagaatatgtcagatttatgctcatcataaaccctagaaaaggcccacaagtatgagtctatgttaaaagaaagaggtgatcttaggtgtgcttttcccaaattcagagggtaagagtagtggacttaccaagtaacctctataggctgcttggattttgattgctgacatttgaacatagattggagtgattaatggttttggtgcaggtgccaacaagtgtgcatgagcaggtgcatttgacttgagcggctgaaccttcttttgcggtgcttgttgtatcctgtggagttgatccctctcagcatcacacagtatctcctcaatgctgcttggttttctgaagaggggaataaaggaattgatctctccatgctttgatcttccaaatccccactttttcttctcttttatgtttttcttatctggcacctgcacccaccaccaccttagacaagtattaagagaatttaattgttaagtaatgcatgtaatttataggtaagagatttattggaactacaatgcatgaaagaatttgtgctttacatcaagaaatctgaaagtctaaaacagggttaaaaggtcagaattaactatattggatagtcaatctgaaaccgacatatctgttgcaaatgagactttcagtcactgcttaaaaaagctccaatgtaagaaactttgtgcagatcatacaaattacaaatatgcgaagaagcagtttacctgtcagtacagatgaaatatactgaaaggcatgcaaaatgtctgaattattactactatgtgattttttcccctcatataatatggatatatcttcttccatatttcttaaaaaaagtagtgtttaccactccaaaaatttgatgttatgatttaaatataaaacccttttctccaaccaaattgttgacaaatggatttctgaggctccctagtccaggtgaggtttttgtaccaggagaaatcctagttgaagttggaatatggcaagttaaagttttaggcaatggaacatggaatactttctgacacatgaagggctttacacaaacacagacactgcacatgccaagtaatgattttgtaaacctttaacagtaagttacagttgaaccttccatggatgtaggcctcctgaggaatgtccatcgaggcatctatatatgcgggctttcatattactattgacaaatcccttaaatccagtaagttttactttcatcataatacttacatcgatcagcttatctttatctttagagcttgaagtgaaggcccttttgagagctgtaaaccaattccttttttccccatctccttggcattactagtctcagctcaaaagcctgagtgcaagaattaaaacaaggataagtacaacactttttgctttgcaaatttatatgtacattaccattgataagctttgagattaatcggtatgtatgttacattcataaaacatttggcacttgtacaggacttcatatatattctgtcacttagtagaactcactgtttgacactatctactagcaggtaaaggctctctgaagaattacaattaaaataataagatggtgattatttcccctagctggaagcttagagaaaaaccaccttaaaagccaactcagatattgacaacaataaagaaaacaaggtgctgctcgctgagttagtttggaaggtcatttctgcccttcctaacaagaaattcttcttcttcttcttcttcttattccttcttttaattttttttatatgttcacctccttgcaaaacctgtcatgcaaagattcgtgacattttgcaaagaaatttaaaaaaaaaaattgctaaactgaactgaagtaaactattggactaattggtaaatggaattgggagtcattggatttaaataacaatgataaaaggatataagaattctcaaagtgatgcaaggtgaacatatggaagtttatcttatccttttccaacacgaatccatttaaattttcctcaatcagtttgtattgcaagagactacaattcccaacttttacatgctgtttcttctaattctaaagcatccattctagttttcacagacgcgaccttttatatttaaattagagatcaagattgctaaaatctttgtgcccttttttgacacttaagaataaatgccacccacaatagaaaatgttctgacagcaaaaatatggggtgcagaatgatcatccaataatcaaacacaaaaaaggaacagtcaatttccttttagcagagaaaaccatcaattttttagaaaggaagcctgagaaaatttgatacgacgagcacgtttatgcagccatctctcatcaattaatctcaaaattatgtaaaacttctgatatataatagagctacagaaattaagcaaaaaaatggaagaaaaggaagaaatcttcaacaccctcagagagttcttttcattcctaaccaaagttaatccatccacttgcttctgaacatctctccaattatcaaaaagtagcaaataatggagcaacaccagaatccattgaatagataatatcacacatccaaaagaaagaaatttatagctctctggtcttgtttctccagttaaattttaattcattgggttagcttagagccgaaaaaaagattttgtaaaactccagccatctctgcatcatacatttatcgaaatgcacacaacagaaagagagagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagaataaaacagagctatatggctggtaccttggccaaactcccagaattacttccaaagctaaacctattgcactggaggaagagatggagacatggatttaacttggtaacttccactcaccctagacaaattgctcctgtgcttcactaacccaaaattatatcctatatgcttttttcttttttctcattcaaggaaccaggcatctagttcttccttgcaaggattgagatcccttttatctctcattttcagcattttttgtgaacagggagtgtatagctctcttttagcttgatgatggagaaggtggccactttctcactccatgacccccgaccaactttacttcactagaaagccttctgaggtgacagaggcacttaaggaacagttggttggcctccttttcagattactgaaaaaattacaacactagaaatgcggagcagcaattataaacagaagcaggaggttgccatgtgaggcaagcaagaatgaacaggaccatcatttattagattcttgccttgcatctggagcatgtggcactgagctggccatccatcatatgggcctcaaaatgtacctgaaaacccaagatggaccacaagcagtcaccctctgtgcttgctttggatcttttttttccatttaaccagtattagtcaagaaattatggggttagacatggtgtggttattttagtatgtagtggactcacatgctatagaaagggcaaagtgtctgccctttaatgggtaggaaatgtgcttgttaaaatggatatcactgtatctagaaacatgctttccctgctgttagattcttgtagatccactactctttcatcctgttagtgaccccttagcttagggggggacacaggaaagagactgttggatgtttgcttacaagctactcaaaacaaagttgggtggttctcttatccaaatcaagctgcttaggtgcgagggttgttagtaactactcttgtaggccatcatctccattgtctagcctcaagcataaactattatctccatttgtctctttataaccgtgatgaattattcatggttggcctcaaacggcggcaaccttgttttattgtgtgaaagatactttgtaggagatctgaaatactgaaattggctgcttggccttgcctcactcttctttcttcgttaacgatgcaaggtactctaagcctatccttctaatatcgaagataccgtctaagatcaacttggatttctctcctcgttttgttttgctttagaacttttttttgtttcacctggatgtgagatccattagagatttggggttgaaaatctaaatgtggcactaaatgcgaggtgcctcaaaatttgagactggtttggagcatgattcttgtacaagtttacttcctaaaaagtgtaactgttgtagtaacaatcatttcaaaagaatgaggacagaattacctaggtctttgacgcagaatgccgaaaggggaaaaatcttcttaaattttcacaaacttacaacactacttgcaaataaagctatcatacaatggagctattcttggctgtatttgcccactatgatttaccattagttgtatcttttttttgaaaaatacactggaataccattctttggtttcaagtccagaagcttttcgtaatgctttataaagagaagggtgccaacctgtggaccttgagtccagtttaatcacctatttgtcaaatcatggcaatcaatattttttccaacttttggtttgttgtaggtgcaaattttgatgggactccaaatgcaagaagcaactcacaactcttttttttttttaagatgcaacgtcccaaacactgatgcagaaatacatgcatgcaactctttcaagacataatttttcaatgctgtgagtttaatcattgccaaaaagattgttgtaagtgcacaaattatgtaattctagatttaatgtgccaacttaaatgacgctagataagctatggtcaaggggatcctatgtcaaactataattgctagcgtccattgggtgtagtttagatgcaataggatgtagcatctgggttgtctagacgttcacaactgaaaatgtgcaatcagatatgatctaaccagctctagattggaccttacaattttgcccttcagttgatacacactttgaccacatagttaaggatcctaaacaagggtggatgatcaaagccttaggactcgtttggtttgcggaattttttttttaaaaaaagtaatttcttaggaagtaacttgtaactttttgaggataggattttaatatatttggttgatcatgggacgatgacttattataaagtagctttatgtttgaataaacatttatttttctagaaaaactgtgtaaaatacctattatacccttagtagatataaaatcatatatttttactcataaattttatataaatataaatattatatttatattaatattaatataaatataatattaatatatattatacaacattagaccataataatttattgtattaatataatactaatatattaatattatttcacataatatgaatattttaatataataaatttattaatatagatataaatatgatattatattagtataaatattatattaatattaataaaaatattatattaatataaatattaaaataatattaaaatataatgaagattaatattatatttatatgaatatgaagataatattaatataagattatattactattcagtatttcatcctaaccatctattgatattttactaaattttaattatggatctcaaaaggatattttaggaaagaaaaaaatactatcatttttcatgtcacggaaagtgtcaaaactcactttctctatgggttttcacttccatgaaatgtgggaagtgactttctatgagaaatactttttctattctttctcttcataaaattctaaccaaacaagaggcactttcttcatttctcagaaagtgcctcttcccccacctctactttttgactttttatcaaccaaatgagtccttagtggcacttgaagatgccagaggctaggaatcttaacagccaaggaagaagacataaatatggtgcaagtctgcggcgataaatccccgaagttggtggggaatatagcctaacatttatcaatgttccatggtatttttataaggaaaagggaggtcaagccggcactgtcaacagtgaaagataggagacaggatgggctggggagttgagtagatgggacatttctttcaccaagaaacaaagcaaatgatgccatcaaatgatccctataatgtgacttattccaaccttttcagaggccaacatgtttaagacacaaatgaatccaagccattatatgttactgatttcggaaaatgattggtgcaggatttgctcatatgcatataaacatgatgaaggcatacaatagctaggcctatctagtatatacattatatttctcatggctttcaggttggatactgaaaggcaccatcattgtttgtggaacacatcatttggttcaaccctccccacatgctagcaactaggacacgatctatgtacacgcactgacaaagtttcggggttcttctttgtatgatggtaatgccactttggttttattgtcgaataaagcttgagtgggcctgcactgaggcaaactcatatttgttcatgaacagcttgttaggcgaccacaacccaatgggatggtcacatagggaatcttgcaaggaaaatctgctgtccaatgacaaattggataccaaagagattattatgcctctcacgcagccttcaatcaataataagttttgaaaggaaatctgttatgtatgtctagtatgctatttatgctgaaacatgtaatagaaagtagaaactattgaaacaagtagtagtgtggattctactttgagaggtatatcattgatctccgttgaagtcaaatatctcggaagcattctagtataactccatgtgtatttcaaagttcgaattatttatttacttcttctgcaccctatagttttcaaaccatttaacaagacctttcagtcccgtcctctgcattgtgtagatagattctgccccaaatcaaccgtttctcgaccttaatccttagaaaatagtaatgtctcgcaactatcattgccctgatggtgcaaggacttatttatcaaacttgagcgacgtcaacaccgcatgctgataaaattgcattcacatcactgacatcaacacgtataggtgcaactacaagcgatagccaattcaattattgattgaactagcacactttgatgcatgattctaaatatttttttaccattgttttaggattcactatacatacatatacatatacatacccacacacacacacacacacatacatgtttgtgttttatttgttgatagcctttggctgatcatacaacttgaaagattaataaccagaagtaggaacatcattgtgaaccgagatgaaaccaacccgaaaaatttctcaagttttcaaaatcttatatgttaacgagatgacagctcatagttaatttgttctttttaatcaaataatttctagtatgctatttcttgtttaacttgtagtaaaaacatattttagctactcaaaaaatattactcaacgtatcgcttggccaatgttgtgtattatttaacagagaactagagataaattttcagctctactttcaacttaaaaacagccccccaaatgagttttatgtaaaaatatctactcattccaaacataagttaagttaaaagcaactacacattttgactgaaattatccttatactttttaaaatactgcagtattaaattattatagtgcagtattcctttacaataagatagtatttagaactgtcaaaatggaccggcccgatcctaacctatgtgattatatgggctgggccgggcttggcccacttgttaaaatggattgtaaaaacccaaccctagagcacgtaggctgtgggttaaagccggaccagcccacttcttttttttctagagtcggatcagcccattctgaagttactttcacagttttctccccttattctcgagtcactatgaagaaaattaaaactcaacacgtaatgagtaataagaaatcaagtagcaacaagattttcaagaccaaacaaaaactaaacttacaaccaagtgattacctattcgcctgatcaggtatgggccgacccacggactaacctggccctaacctgattaagcccatgggctacaggggctgagtcaaaaagtctactgtcataaatggatcaaaatttctcgacccaatccgatctaattttagggtcaaatgagctggtccatagatcctgacccattttgacagctctagtagtattacattatattagtgtaatatttttttataataatacagtatttctttattgtattatattaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatattcctttacaataaaatagtattacattatcataatgtagtattactttataataatgcaatattattttataatagtatagtattactttataataatataatattatttttattataaaataatattattttataataatataatattatcttataatagcataatactgttttacaactacaaagataattaaatcatttcatcccatttgagtagttacttttaaattatatttaaataaaaaaattatttgaaattaaagtagataaatatttttaaatttaaattcaattaaatatttttcattaattttttctatcctcaattgatccctttacattggtaccatcaatggtgcaatttaagagcatggcaactttttaaagcaatctcaggaacttttctgtgatttttccaagttaccgtagcattgctctttataaaaaacctatcacatttattgcgcctagctcattcaagtttacataacaacctaagaaacactagtagaaaaggaaaaaaaaaaaacatggatctaaaagtgtacaaatataaaaattaattttgaaaacacggaagtcaaaataatgccatctcaaccttctccataaccaggtgtacagaaaaaagaaaagaagaaagcccttacattattttcaagtatattacaactttaaaccagatacaaagaagcatgataacaccacgcagaacttaatagttccttgggtcaggaatgaaccaagttcgtgtctagcaaatcctatcagaactctcctaacactgaatattaccacaacctcaattgttcagttcagcaagcttttactataatactagtagggggaaaatgagatacaaaaggaacttcaaaaaaagaacatatatgttttcccagagagagagagagggcatatataagaaaaagtactttacatttgacatgttgcatatccctttgaataacctgtttatatgatatgtacgagataatgttatacagatgtatgcacacaccacaaattcactcgcactgaggcagggtgagaagacagcacaagtaccagagcaggccaactgttgtaacatggttgctgttgcaatggctcgagagatgggacttcatcaaggccccgaatggtgtgccaaatgagggtgccaagcaggcagactttgcatgaggatactgaggttttcaatcaccttcagcaggggaaggagttattgatgcctcatcaggctcttggttggaagcctgggccttgagaaggtatgagcgggccacttctaacatctgggccacttctttcttgtactgtagacagaaaaagaataagcacactttatatgcaggtaattaggtttacttttgcacactacatagttttattcaatgaactttgtacataatcatatagaggaacattagaatctgaacttatcacatgcaacttgaacaatatcatcagttactaagaggtacaaaaaaactcacatcaaattttgccatttgctactttaccaagtaatatgatgaagcctcctaaatttttaatcaatgtcgtgactatctctaaatgcctccaagggtaagagtacgaaaagtccatccaacatattccagtagcatgtagcagatacaggtgaaaagataggcaagacaaaatggagatgtagaatcagttagtacaacagttgaagttgttcaaggacgaggtagcatgtgcaactcaatacaagggcacaaaatagggcacacataacaataaagaacagaaattcttgatgataccgaggcttggcccatcatataatgtccctttgatgtatatccatgattttttgcaaacatagttttgcagaactgcatttgtagcattaactagagtgcagcatgactcaaaatggcatgctcctagagccaacggtgggataaggttggcataattcatacgagacagtatgtgcatgacaaggagataaagcctaaagatcaaggccaacataagctaaatatgaaggccggctggctacccaaataaagttgcattgagataatggatcactacatggcctgtttggattcactcataccagctgtttgaggtaggggtgcatgggcttttgtcttatccagcataattggcttcagttgcagaaaaaacataaaacaaaacaaaactaagggatggctatcacttcaacaaccacagttttagaagtgtccacaatacacccacaaatatatgagagagaagcccttggtagactgcactatttagaaagaaatgaggttttgcgaggaatactatgatttcatatgtcagagagctgtgtgattaattgtgttgatgaaaaagaagaggtgtgcttaagggtcattggtattattaaaatacttgaattacatgtgataaagcaaaatagactgcatagcttcataattaatccatacaaaacaaatagagatagtgaactgctttgtcgatcaacccctcaatgctaaacaaaagaactgcaacagtacttggaagaacattcatgtgtttgcaacaaacaacatactgatatgtatatcagaaaattgtttttaacaatcttttcagaaaaaaaaataattgaattaagttattaatgggcatatgtaaaacgaaatgtcaaggtagttcaggcgaagtgaaagaatactgaattatgttggtcctagctcctggaaggctggaacaattcaaaaaggcttcaagacatcaggaagcagaggcaagagtggaagtaggattcactagttcaatgtggccacctaagatagaaggttcgcacaactagagtggccttgcatatgagcaggtgttcatgtctgccctgatgaacaggatctctatctactactgttccataacatatcttacccatactgttgatcctctttcaaaacaagcaatgaagataaaaaaactagtgcagaatacataggaagcaaagtggacaaaggagatgaaaatgaaatgcaaacctcatcgacagctccagtctttatcttagactgcataatgcaccatctcttaaaatgagcacctgcaaaatatccaaaatttgctttagttcttttcattggaggtaaacggtgctagcatagacattaagaaaaataaacatctaaaactggaagacaaaagcagatagacaacaaggaaaaaaaaagggtagaagatcgaataactcaccaactcttatgtcaagcatacaagaagactcactgtttgttttcaacgaccatctgcagtgtacctgaaacggttgaaaataataacattattctcccaaaacttcgagttgttgaccttctttcacatatgaacaaatgaaccttatagatagatcaagatgataacattgaattaaacaaagggtggtgatgcaagtctccaggtcatttgatgcatacatagtggacattatagctcagtacaagtgcaagagaatcggatataaagccagtcaaaatcctccatatgatcataccatttgaaggacaaaacagtaaagtctcatttaatacctcaaagcaggaaccaaatggaatatcatgtgcctgttgcactgtctcaaaaacctgatagaggaaaatattgtgaattaaatgaaaaatacgcataagaggagatttctggagagcaaactaagaagaatttgaacaagccataataatatagaaaaatatcttccacatttggctttgagagattgagtcaataaatcacaccaaagttgttttatcggatgaaagaactgcattctgccactccgtcatggctgtgtccgggggacacataggactatgacataatgttctgaatgttatttctctgacttgaccatcatattcatcagcgacatgccactggcccaactgtaaagaaaaacaaatactgagactatgataaagaaccaggagtaaactaatattccagtggcatctatgttattctctatacaaacaaatatagcaccatacgcacatcactatgataatggtatgcgacaggacaaacaaacaggcgactacacatgaaattgctaggatgtgaggcaataaaaaggcatttggaagatgataatcctttgcatgtctcagttggcagaaaggcccacttgtggggcattccatgtttgattcatgtaattatatatgatgtattgcccaacagggcacccagaatgaagaagatgatagcacctctttctcacaatagcaccacatgccttcaggtgaccaaaagcaacaattggcatatcaatgaatggcaagctcattgaagcaactgcatgaagctttgccacagacatacacacaaaggaaaaaagggaaacaagaaagccaattacataacagaatctatcagtgacagtcagcagtcaaaagctaatgaatttcatacagcagaacttcaaagacaataacatgagagataatcattgcatgctgacacattacatggagatttgtatccttccgtgcagtgcgatattcctcaataaactttgagttgtcacccaacagcacattaaaaaactgctcagctgtgcatggaaaattatcctgggacaagattggtgaaacaaattagataaaagtaaataaaatttctgaaatcaagtatctgttatggatgatgaggctgatgtgtacattaaagatgccaactagaacttcttctttaatgaaatcttggaaccttcctgccttctcaatattatcttctggaattttaatctgttttctactacctctgacagagctactgtgtgcacgcaatgctgactgtgcccactcctacatttccaaataaatgcaaagcgttaaaatttttcttttcaagtattatatatgtgaagacacacaatcatagatctaggctccaaaacctaaaccatttgtccaggtaccatatgaaaaacaaacagcttactggatattggagaacctgccagatatgaagccaatgcagaaaattttattacagaagcaagcacaaagtagctttgaaagacattcaggttgacttggatatagttaacctgatcagcattactaggcagtaggcaagatcaccacactggcttattgcattacaagatactaaagattaacagaggatttaaatcctaattatgcataaatagtactattcttaactgatgatcagttagagaagaatgcaggcataattatggagaaaaggagtttgccgcatcatatatcagaattcaagatcatgcccactaaaacatcagggtaagaaataaagacctgacaggaacacaaaattaaaaccaaacttggatcacagaaagcagcaatctctattagaagcccaaaaggataatatcctcaatactccaagacagaacatataaatgaaatttatcttcaatagtgacaattgaagagaaatttcttaaattgtaactgaaataggaatttataaattgaattagaacaataatgccagaatctttaagattaatattcacattcccataaaaagattcaaatgctgatagtctttgtactagttttccaagccatgacattaatatagtaaaataaaatttcatctaatccataacaaaaatttaatgaaacctctgcatattaaactataataagtgcaccataaaactagtgtaatgtcccgatgcttgggatgcaaaatagtagtctaataatcatagaaagacaaaatactggaccaatttctatgaggaatacctgcttctcagcttctaacattgcacggaaattctttgttgcacgttgtaaaattctcagtgtatgatttctgttccaaaaagatgcgaatttgtacctaactcttcctgaaaagcagaagatggaaacatgcaaagcagttaacatctcatactgggttccagaaaaaattgtccaaagcagggtgcactaccagatgtttccagcagctattttcataaaagcatttaaaaaatgcatcattgcatattcaaatacagattaattagtgaacgagcatgataaaaacaaaaaaataaaacataaccatgaagagtcactggatatgttataacatgatttcttttctttcattctgatcaaaaaattgatcaaccattgcaacatatatttcaagtttaagcaaggttttcccaccattatattttcttatctgtgagcattgatgtacatgcaaacatgccagaatgcacaaattttcaaaacatacatccactgaagaaagaattgaatatccaaatgttgctatcagaactctcattcattcatgggccaaaaagcaaagagatgcttctatgcagaagggatgcagtaaatgtgacaacttgaatcaaagattaactccaacatgaggcacaatgacaagagcatgattttttttgaatgcagagtaaacaaaccttctcagattatactacaaacatgaagtttccgagactttgattgatatgcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacccatgaagagagccagctatgtttaggcttaccatctaacttttcatgttcttagccagcaagccttcgatccatcagaccttataatcaacttacatcatctttaaatttagaaaggtattacaaggttcccacaaaaccttgtaattaccattcaaaactataccaattaaacccatattttcagcatggcaatgaatcaaaaacatcaagagaaaatgtttgagaacattgaataaatacaggagttatgtgaaatgcagcccaacagagaattatggtaaacttcacaagatagatctaaaacagagatgtacatactcgcagaaactactaattcacatctatgaaacttcatataacaaaagcatgcccaactaacataacacaacaaatatagtggtgaaactaaagagcactccagttgcccgaaccaccagccaaaccataatccccagcccaccaacctccacacacagaaaaaacactccatgtataaaaagaatgagaattaaaaaaaatgagcaacaaagtgtttgtgtaaaatttttatttctcttatccagaagcactataagaataaataactatccataaataacacactaatgcttcaagaattaagaaggttacatgagcaaaaaaaattatttagctactaatattcaggtgaaaaacttccttactacataatgaacagaatgctaacaaagggaaacaaccagcaggccagaactgaaacaagaaatcacctggcagtacttgcaggaagctttaccgttcttatatgaagacaaacctgggaagaagttcttttcaataaaaaactaattgcagaaagatccaagcatatgatagtttatgtatcaattataaagtaagattctacctgtcctgatgtgctatccaaagtgtaccagatagctccagtttggacttcactttcaactggaactgtcactgatccaagaactgtgcttttccatattatgtcccagtcatatattgtcacattaatctgcataaatcgttgaaaataaaatccaatataataagactacacagacaataacaattttaaaaaagcattaaataataagtgtgactgaattgaacatgcatgtcatcactatggacaaggataatgagcattctacaagcaaataaaagatatcttatggtcatatactatcttcaccaaaatcatatcatttaagatctttttgtacgaaaacaaggcttatgttttggttgtcaaaaagtagttcattaagaaaatcgatttccaagtattgttgttgcatactacttatatgttccaagctatatcacatctttatcaatgcatgcttgtagagggcaacctatgatgatataggtgccataaaccacactctcaacctcacatgttcagaacctttggtggaccaaataatatagccagtggatacaatcacaatcaatgaactatatcatgattagtacatcacacaaagttatgcaataaaacttgtttggtgtattgaaggagagcaaaccaacacaattatgcttgtatatctcaaaccatatgattatatcctgatgcacaaccacattacatgtttattacaccacatcgtattcagaacattatacagaagtgttaacactaaattatgtgtctagcatgccatgcaaatgcttcgtgatgcactgacataatgtgatcaatgtgtacgtactgttgtacatggcataagaggcaagtaaagattagcacattgtgaagtcacaatatttaggaactttactatagtgtcaacaaagtcaaaattaattctgtccataacagcacacagggctgataaattaactctttatgttttgttagggacaaagtctcatacaaagggtcaatagtagatccagaaacccttgagaaaatatttctatgtcgttatattatctgatgacctatttcaggtggactgcataaacaaactaatgtaaactaggaaaacggggacatgaaataacctggacaggaagaacatcaacaataaaattgaactcctctccccaaattgggtttcttgagcctggtaccattgagctgcattaagatgatgatagcaaaattgtattgaggcccacatttcatgataatttcgttacaccctttgcctaaaataaaaagttaaaaaatccggctaacaagatggttttcataacaccatatttcaatgaaagtcagaatcaaatgacatcagcaaaatacataagcctattgaactttgaagtttgaacaatttcacaatatcagatatgaaaaataaatttaagtggttgaaacacatgacaaagtacttaaacagacaaaaaaatgagagtgtaaaaatcaaggtttgccatctcgataccggaccccgtaccggtaaaattctgcttaatgtcggtacgtggttcagtacggtacaataatgtcagtacgctccgagatagcatattagtacgtaaccaatacggtacggtatgggcggtacggggcggtatggggcgatacagtattccatggtaaaaactaaaaaacaaaacattacatcactcataatgcttagaaaattgaacatggacatgaaacagagttattgcttatcaggctactgcaatatatttaaaaaaatgtacttcatgtaccaagtgcatgattaactactatgagaaaggatataaatgattttcagagtctaagtttattttttcctctaacccacaattaaagtcacattaatcaactccgctacttgctccttaagtgtaataggatagaccatagcatgagaaaggtaagctattttccaaagactgattaatgattctgtagtatctcgctgaataagaccctatattttcgggacaaccgcatgggagaagaaactgagataaaaatatcaaaaaaaaggaaaactccccaagcaacttatgtggtgcaaccaataacaactcttcttccccatcttttcaggcatctatcattttctgcagactcacttttgatttcttggaatattgcatgtggagagtatgctcccccaacaattgttcaattattttcatggtgtcaaaacaagggaccagattaacgctactaaaaatgccaagagctaacatacaagatccgataaccaattggcaatctccactaaatcctcacctgcactctacctaatggcacctccaagaaacaccaacatcaaacataggaaaggaaaacaataatcatcttcatggtttgttgtaccaccccatactggccttgtaccaacatgctgtctcgtgccttaccgacactcagtatgtggtctcgcactgtaccaaaccatatatcgacactataataggatgatattggtatggaatctggtactgagatggcaaatcttgatcatctttttatctatcaaatgtttaaaagcattaggtaacaattggtcattcaaacaatttttctccatgtcttcactaagtaatgaccagtcaagttcaccaggcaatgtctacttaccagatattttagcaaaaaaggtcctacaaattcaatcttttaatactaatgtaagggtgattttttgctataaacagacagtacaagagtttaccaaacatatacggtagacagaattaactcaagagaaacaagatgcccaaatatttcaaatatcagcaatgaaaaaaggtcactgtagtcacctaaaccgcttttgttccccacaagtaattattgcataaggatccgatgtgccattcaaatttgcaccaactaggttcttggcagccaatagttccaactgaaataaggaacaaatacaaaccatcacaaccaaatcaaatcaatacatatgatctatatatgaatatagcaagaacatgtaaattaaatggataaaaggagtcatgatttgcgggctccagatatcaaaatctctttctcatccaagagattggtgttacacaacacgaaatacctttactaaatatgcagaagtggcttgagaatctcctttagattggctcatctacaaaataagtggagaactgcatgtcaaacaaatgaaaaaaaattatttcatgaaacagataatgagtaaagtaactttaaaaaaatacaaaaaccctttactttttcaaatatcaaaagcaatcaagcccagataaaagcctacatatctatgctcaaattaacataaaattgtaacaagaaaacgaggtataactatgaaaaaagacatgtacatctatataagcctttgactggttagcaagcagcgacgaacataaaacatgttcataatccagttcaagttatgacaggaagctaataaatccaataagtcaggaagcttaaactatagccacaggacagcaatgcatatgcccactcccttccacccaatgcccaataacacatgcatatatacacatataaatgtctagtttacataattacatatacatgggtacatacatgcatatacagagattgacagacagacaaacagacaaatatataggtcaagaaaatgaggtataaccatgaaacaagacatctatataagcctttgactggtaagcaagcagcaacaaatgtaaaacatgttcataatccggttcaacttatgacaggaagctaataaatccaataagtcaggaagcttaaactttagccacaggcaagcaatgcatatgcccactcccttccaccccatgccccatcacacatgcatacatgcacatatacatgtctagtttacataattacatatacatgggtacatacatacttgcatatacagaagtcgacagacagacaaacagacaaatatataggtcaatatataagagaactcctcatctattttttacaggttaaaaccatcatcaaaatcacattaagattataacaataccaacatcaactgctgttacaaagccctcatttaagccgttattatttcaaccatttttgtttctttttcttcccatcagctacctcaaacatgagttaacaaagtttaatatgactacttgattagtacagacaactgtttaactgtaacatgaacacatgatggtgacaacaccctaatgcactaaaaaatacaggattttgaggaccctgtatcagtgagtttatagggaatttgattccaaattttacaagtagcaaggtagaaaacaagcaattgcaatgttgcatacatgtcatgatgccatatgcttcacttgcgtctttttccactttttatttggatattatgcccatctacgtgtaaatacatttgctgaactaccaagcttccacagcatgtgaacactttgctgtataatattacaagcaagctaaaacatatagaaatgatcagtgaccatatagaaatagaataactagaaatcagtttaaacaccctaagtggaaacagattgtgaacgatagagcatcatggtcactgtcttgagcacttaactgttcttaacagttaacagacaatacgtcaggcagcaaagagatagcatttcctcattgcctggggagataacacaaaagagctattggcctccaataaaataggctagttatgtgtcaatctactggttgcctcaacactaaaatatctgcatctcctgagagctctgtatgtatccctctcttaagttggaacattgggtacaacgggtgtgttagatgacctttaaaatagtgactaggaaggagttcaagctcttcaaaactctaggctctagcatgccttctctcactctcatgagtttgacaaaagagaagaagggctgcgtataaagattaagaaaggattctgtccaatttcaagtgcaccagaaacaacccaggaaacatccagctatggaaccttactaacaacagtgttttaacaatttaaacacaatcttgcttgtccataatccaacaaacaaaaacacttcagcattgattttcatttattgtaacaccaatgcaatagtgaaacatagccatcttccttgaattcagcgcactaactaaatgaatatcatcaaaaagaaccatactgcaagagcactcagaaaatgctggtcaaatacgctgcagcttattatcttggattggatcattgtgtcagtcctaatcaaaattttggttatgcattgcccagatagatccctttgacatccttaattcaaggtgttgatagtatttaaaagtatagctggtagtatacacatatgcattatgtccaagtttgatgcataaaaggaaaagggttgcatcccaaattaatcacatagatcagggtattgctacttgcaggaacttactacaggtatcgtgcccagtccaacatttgctcgacaaaaacaatagtcccaaacaccaaactgattgactaaacaaatgtgctaaataatgactccctcatcaacaattgtcttgacggaaaataataaatataccaagaattttgtttcaattcccattaaccatctaatagagagaaaagggatgacactagttaagcggtagactagtgatcccaatcgtggtaaagcattgaatgaaaagagttgatcttcaaagccaagaattcgggtagggattctttccagtcatcacatcgctttgcttctatttctttacttgactgcctcagactctgcaagacctcgctcttcgaaaatgagttagaagtgagagtggatgtcaatagaaccatactttgccatgtcaataggagagagaaagaaagaggacagcaagaggaggccttgttatatatttcaggagagaaaaggaaaaggcatcacctttacaaatcaagtcaccttagatttgtctatcatccattatttctcacttcttaggctccatttttgggggagccagaaagtactttctagccctccaaaagcactttctagcaaatgctgggaagccattttagctttaacaaaattttcctagtgactaaaatgcccacgaacaaatcccacaattacacctctaattgttaactaacattagctatattatattattatatcatatcatatcatagtatattatcttatgttatattatattatatcaaatcatatgatattatattattatactataaatatattatattatattattacattatattataataataatacaataatgcattgctatattatatcatgtcatataaaatctacattatatcataaaaacatactataatattatatcacattatattatactgcaataatatattatattatattatattataataatattatgctttgtattccactatattttaataatattatcttatatcaaaatattaaatcacataatattacattataagaatattatgctatgtaataatatcataatatataacaacatataatattatattatattatactctcctataaaatactatgtaatattctttattgtcattttgtcataccaaaagcactttcacttttgccaccaaacacttgttacagttccatggcactttagagaggtaggtactaaatagcaaatagttttttgtaaaaattctacttcccaaaagctttacttccaaaagcttattaccaacagcaatcccaaatagtgcattagttgttcccaatattccaattttatttaatcctcttgatcttttccaatgttatatcagttgttctcttttttcttttaatttcacaattcacccaaaaagttatattattactcaagttcacaatattgatactggaccccctgctagtaccatgttggtatagtgtcaatacgcgagatacaagtgtgtaccaacacttggtatgtctcccctactgagcatcaattcgatacagatataatatggtatgcctgatacaggatggcaggcaccaatattgcaaagtgcaaaccttataattacgtatctttcttcatacaagtggtccgaaccaacatacaagattaagattttaaacaattacaatgatgtccagggtccacactaccctttcaatggaggatacagtgccaattgcaaagaatcacaaacaagcattttgaaactatattgcaattgattcatttcctttctagaaactatatgcgtgcgatatcacagtagaattgttcaatttacaccacactgtaattgacgagtgccgatcaatatcaccaatgctcatgctcatgtataacatgtttttccagtagcattgagcaaagcttacggagttgatgagaattcagatactatttgtaaaattatggcaactgtatcaagtcatataaccttttactttgtcatggtagtcagatgatgctaaagatttgtagaaatcccataatataatcaagaagaaaaaaattacatacaaaataaaccaaagcactagaaaaacctattccatctctttgtctccataattctaaacagttaagaagtcgaaacttccctttttatcttataagaaagcctcagaattttcaaccacgatcattgagcctcagcttgtaacgatgacatccttaaattcattggaaactaaattatctacccatcgaagaattgctgttttctcaaacaaacactcgactggaattccaaattaactgatcgataaattttcaaaagaaaaaacaatttcacacaactaaccttctccttctcgtcaagaagaggctctttcgcagccaggagctcatcgccaccagacgaccgatcgaccccaatccccgggccgccggaagagaagcgttcgaagaaggtgtagacggcgatcacgaagagcgccgccgcgacggtaacctcgatctcccaccacgaggggaaaagcaaaccgatcgagacgtctcccatggccaccgagagaaagccgacgcccgcggggctctagggtttcttttgggcggcttttagggttccttggtcggagagggtccatggtaggagagggaggaagaagagagcgcggccatcccgagagagagggaggggtcaaacgagttggttggagggagacggcaaagacggtgttattaattagggatcggaaacgaaaaaaaaaaaaagggaaattaaaggaaaagtagtgggttcccaaactgcccttgctattaatgaagggctctccagagtgccatcttttgccggactgggcttgttctcgctcgtcgttgcgttcgaggttagaatagaatcgctagtacatggacccaacgacgttaccaaggatgactctttcccatgtggcactaattcattctggaagatcccacgaccaactgcccccggtgaagcagaaattatggtgaaacgcggcaacggcaagctttcgtacaacggttgggccccaaaactttttcacgtgaatcaggatcctcctcactcgcgctccggcgttcaaagagccgacgttaagacgtctgctatcgaaaaaagaaaaccgttgttggtaccgaaaaagaaaaaagagaaaacaattgttaccaaaagaaaaattaaaaaaaaaaaaaactaaaaagtatctatcttggttttaacatgcacgtggttcacgaacggttttgctcattctatcacccatggtccctaaaaaataggcctaaaaagctcaataactgaaaaaattataccacacacgacaataaagctgagactttctatgactacaaaatcgaaacaaagtaattgatatgatgcaccattatacagtggtaggatataatttctcatgtttatgggatatactagatgtactagggatgcatgcaaggcaaacatcaataactttagtaaaaaaaggaatttattaatttatatagaaaaattaaaaagatttattagctgtgatctttaaaaaattgtaagtgtttttttttttttgtgtccatgcatagttgggtgattcttttgaaaaacaatattaagtggatcattctatgggacaagtcttgatagttgatctagtacgcatgtttaaatgaataactaaacatgatattaagttaataattaaacatattcataatttaagtatttttcatggataccttctccttttgtcaagatggaagggactcaaatcgaaaacactagtacctattttactaactttaccaactttgttatttagcttcctcaaattgatcaaaaatatatatgttgatgagataagcatgccatatcaatagtttcatggaatttgtcctataaaatgctccccaagtttttttcctaagcaaaataaaaattagatcaaaacaaaagttttataactatatatatagttatatatataattggatatcttttatgcatattgttatgcatatcttgtgatcagaacataagtttgttttgtgatttttttggtgaagtgtctttcgttccaataattcttatttttgtcccaacaatttattaaaaaaaaaataatgtatggtcttttcgaattcattgttggtgcatattgcttacacacatacatacatatacacacatacacatatatacatatgtatgtatatacgtacatacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaacaggggaccgacaagtctcctccttttgagttccgaccggcggtgcagccgacgtggggcgaccgtcggtaagaggggggcggcccaacgacaagaggagggccaaaccggtggtcggcggtgaccatcggcgcccaaacatccaacggaaccggaaatccccccttttctcaaagaaatccgacgactccggtcgtcggcgagcatgcataccggcatgaaaaagaaaagggagaagaaaggaagggaaggaggcttacctccgacgtcggcgagactttttcggtgagcaaattggacgggcacagatcgatcttccgcggtggttttccggcgattgccgccgactgggcttagaatcttcggtggaagggagagaggagggatctcctccttaaatagagtgagaggagagatcttttccaacttcgattgagagccggcgagaggaggaagaagactcccttcgggagttcttctcctctgttttttttttttttggctttggtgggttgagatttttactcgggtcgggccatcacagtggtgaagcaatttatttcaagctctcaacgaaacatttcccacaccagacaaatacgatattagcaatccatgtgaagtatgccatatacactgctattcatcatatagtgcccggtcatgcatgttctacaaacattcatgtggggggcgatagagactaaacccacagagaagtgttcaatcatagaaaacaaattagaaaggtcaaacttaaaaggctcctcagggcatggcaagaatattattctgcctgccaacctattattagggcaccacagatagttgtagaattcctgtttgagccatttgagttggtggagcgaaatccttgatcatgttatcacatctttagggtcttatggcttcatgaggatgctgctaccgccagccaagctgctagttgcaaagggaagatctcgaactagaagcctcagactttgagattgcatagactgcaacacctcaacacactcctgcaaatcagattcatcggccaaattgacccattcgttctcatcatccatatacttgagttggaatgtcccgctgcacaatttgaatctcttctcaatcacctgaatcaactgatggaaacccatggacaaggagaatctgaaccttacagtgtcctccttataagtagcctttacacggatcgcagacccgaagtcagtggccgacatattgttctttaagcttcttttaacagtggggcaacttgaagcactgccactggatgagtctgccatgctggaataagaaggatgactttgttctatgatctgttcgctagcatccatttgggtatgcatttcttccactattgccatcgagcttgagctttttgatctagtgctgcatttaaggctctccggaccgaagccatccttgctagaagcatcatggcagcatttctctttagcaaggctggatagccctccgccagaagtaaccttacatttgtcactcatgccaaaaggtggaatagaggctttatttgcttcatgatgatgaagttgtggttggcctgaattgccaatcttgtttctgccaaccaaacaagcctcttcttccaatatcccaccaaactgaactggtaaacatggacgcaatggttctgaggctgttgccgcttgtttttcaggcgatgagacttctgtcaaaagttttccagtagcattatcatattttaacatacctgcaactcctggtacagagtctaacatgttctggatctcactcagagaatggctggctttagttagcttgcgagatggccatcttaatatcccattccgcctgcatattctcttcagcgtagtttgacaaactgacaatatggaatattcaaaatatatcagccagtttctatttaatgagttgactaaaattaatacaaatcgaaaagttttatcgcatcgattgaaattagcctgaggctcaatacttcgcaaatttttcctttgtgtgtgttacatcttaacatcgaatttttctagaattacttcactaatatccatatcatctttaggtccacaatatttcttttctctgactcattaatccatatatgagtctcccctcctctcaccaaggccacatctgaccgggagacatcccaaccatctcaggtctttcagtgccgttcctaaatttcatttagctaactcatctgtaattccatctctcttaattctaccacatcctccataacatcatcattctgccattgtatcttaagatgacaggccaacttgatctttatctgtatgatatagttagagtcataagataggtgatgtcatcatgcaaaatttaaaggccttctaattggcgaagtctatactaacaataatagcacattagcctagctaatttgataatttttagttctattctgaggacctcatgatccttgtcgtggtcttggtaggatattacaccataagcaaagccagtaaacagaagaatgtatcgcatgctaagttccaacaagataaaagagacgaaaagaaaagctcaccaccaatgctctttgcagcatccttaagagtttcagaatagtactgttgaagaacacttagattaatattcttttccactgtactacgtttcttctttggatgtctaggtgagccagacttcatctgcattatacaagtaaattagtttatgagcatattaacagttgtcatttttcaaaatttccactgcaacttataaaatctaactcacaaagaaatgaccacctgaatgctacaaaaaaaaaaagaccgaattaaagatgcatgcttcctctttcaaggctgcaactacaaacaaattcatgacaacaacagagaccaaaacttaaataaccaaattgagcatcacaagcatgcaactaggaagctaaaatcattcaccgtgcaatctgagtttcctcaactttcgcaacatatgataattaatgttctctatcatgtatattcagcagcagttatggactttctgccataagatatatgcataaacagatactgacatatcataaaatttggaaaatctagagttcagtcatgttccttatacttgaacatggagaactccaagtagcaacaacgtttgctgttctagatttcatttggctagattacagttaccatcattttatgaagacaatacagttaccatcattttatgaagaaagcacccctcaagctggaacattgactcagataggaagagcttaatgtgctttgcagttattggcacagttaaggtcatgagagtttaagatgtttctatccttcctctagatgttctgttgattacaatctatagtatcgcataaagagtataattcacaaaatctgaacaacctgaagtagcaatttggttaatattatgtaggtgtaactttgtaagtttgcagctactctgatcactatatatcacaagctatagaacctatatgacaaccatgatgaattttcatagaataagtatttagaaacctgcatctcagcatcattaacaaagatgtagtatattcaagcctgctaaatggttatatgttcacttgtttcattactatattaactaaaataaaccgcatcctttttcagttatctttatgttacttggttagttttggaggatgtgttttttacttcctacattacacctcaaaaaaatcttcctattacttactacaatagggaacagaaagagtagttactgatgcaagggctacagtttatagccctaggtagctagaaccatattgtcaaatcttcaatttaatcaggattcttcctttcttctcttaaatattccctggtaacaacagaacttctcttcactttatagcagtactgtgtcatgaatattcacaattactttgcatgaattctaaaaccctccaagtcttttttttcctgctttttattggtatcaggacctccccatgtgcatgtggcaaggcacgtattataaagacaaacagttccgaaatgttgggcaatgatgacccatatagccaaagatgaatgatttagtttttgtttccaggattctacagcgtgtataatttcaaataattagtataatgattgtgtgattaagatcagcacctgacttggatgagcatctccttgtttaccagcttccatatcttgaaattcgaaaggtaacttggtcaagttacattcagtatcatcgtgcaagtgttgggagttttctgctgagacagatatggtttgtcttgttcctggtccctcattagtgacatcagttctgatcgcctcagtatctgaaactgttctcaagcttctgcagattctctgcaatgtaattgacatgttgttcaaaaggagctgctgctctacactccctttacagttgataggaaggaagaactctagtatgtaattgtcgtttcctgtatgggcgctccttaacctgattgcaacagcagcatgcaggccaaatttgcgagcatgatgtgcaagtgggtactggtgtacatcgtaacttttgatgtctgaagagaagacaggatgagttgattgaattgcttttccagcaatgccctgcccattttgaaggtggtgttcagaacatgcacgtagaaaaccctgcatttgttgatcattgacatagcaggccgactcctggatacagagcacgattttcctgtctgaaataaagtttgcctctgcagtatctcttgtacattcatccacacatcccttgttgctcaagggaacccatgtaagtgccaaaggtaacatgtgtgcatgacaaatggctctcaagacatccaatatctctgtgaatgcagacttctggcccattttaagactctgcagttttaaatcatgaaacatgcaaagaaacagtgttataaccaatatataaatcatttactggagggggaaaaccaccactctgccaccgcaaaattaacacaaacaagaaataatgtccattagcacctgctttcgagcacatattttgacacttcttaaattcacagcctgcaaatttagagggagcagaaattttagatatgacataactattccaaaatagcagaaacattaagtatttattggcattaaacctataattgttatatctatcacaaacaagaatcttcatgtattcattctacatgcttgtgtaactaggaacatgtaaataaatacattgacagacaaagatgtccatgcatatgcacgcaggcagtggctacatttatgatgagaagcaatgattgacaaatggaatcagcaagcagcccattcttaattgacaattatgagtaacttctgatgtatgcgattcagtaaaaccatgaacatgacttcgtttccatctacacgctaccaatcaaaacttggaaaaggtgaaattccatatgcaacagaagagaatcatctaaaaagtactcagaccatcatgatgtggaactacatgcacaacacaatgagaatgttatttgcagaaaataatacattgaaatgatacataagcataaacaagtacttgatggaaaataatgcagacctgcaaagctcggaaaatgctatccatctcagaatcaaaatcagatttctccttcaccgttacaagctcaaggactccacagcatgaacgttcattgagatcaaacattggtaccgcaagtaatccacggacctcataatcaagtgcatactccacccgcaagtactcttgccggtgataataggcaatgtttgaggtccattccggcattccagagacaaatacacggccaggaagcccagtgatggaccctggcgcctcttttgcagaaaaagtatatgacctcgaaacttctcggtacccagcaagaatccggtccagaagatagggctgctcatatgtacttaatatatacttatctccctgattcataggcatccaggcctgggcaagtatccctgcacctgaggattccttaaacaaagacagtgccttgagcaatctctcagcaagactaactcccatcatggatttgggtacaacagtgttgcgttcctcagcatcagagacattgaattgaagcccatttcttcctggcatatctatctggagagaattcaacaaaaatccaggttgcaggccagaattttgtggtgctgaatcatctctaaaacaagcatctacaccagctgaatttatcgaatcatcgcaaatcctaggcacagaatccctgcatgatgcttgtgaatttggcgaagccagaaaagtctcactaccagggttcagccgagctactgagtagatgaatggcgagagaaccgggtcagcaatcggtggactgcagagttcagtgaacgtattgatagccttctgcgctgagtcgctaaataggtccaccgacatcgggctcccactcccctcgaggaacggagaaaacccatccatttgagctgggaaaataacccaaaccagctcgttttcctctagctcacagtggatattccattctcttgctcgacaaattaaaccttgacataatacctccctccaaccgtaaaaaccagaccttttactgaagaagatgatttcctctatatttagtaccggaatctctccaagaagtgataaattctagccaaagatccaaactttcatacactactgagctttgacgaccaagaacaactagctcaaggtcgaattggatcctgaactttccctatcaaattggaaatctcagacaacgatgaactagctcgatccagtccggacccagcgaaaggcccaacttttcacggacttctctacttccaggaccaaaaaaaaggctcatagctctaaaacagatcctagaaaaaaataaatcgggaatccagaatccgccctcaccagatagatccagtctctgatccagggcgatattcccgaaatcccacgctgagatgcgtcctccgcgcctcgaggatttcgaagacacggcgtggaaatcggagaacctaggccaggaggaggaggaggaggaatctggacattttgtttgaacgtcttggacgagagctggagctcctcgtagccttcgtctccaagagtcgtccacttcctctacttccaagctctatctatttcaaaattttgcgaaaagcggaggcttgtgcttcttcgctgcgtctctcctttttgtggctgttgtaaacgacgcggggccggcgaaggcgggaggcgacaacctggcggcttgttttatgattttgcccccagcatagcataaaattacaggaaaaaaaaatgtgcttcccgtaatttttctttgttttttttttttcagattgttgttgtaaaaattaatttcaacatacatcatatggtttatacatttgtgacatccacatgtacatgccttggaacggtttacaaagtcatagaaattttcttgcttctgggttgcatgagatcacattgattaaaccagttttgcttgcttaatttttaggctcctattgatatatctagctgcaaataatgagttcgaaacatctctcatttgggattgaactggagatttccaatggccaatcaacagctatatgtgtctcgttgaaccattgatgattgaatggaatccatgacacatgcatgcatgcatgcagggttgtctctgccatgctcttgtactggatgttcccctatacatccactattgataaataaagatgcttgaaagtcttgcattgccttgtattgataggaaaaattaagagctgctgctcaatgatgaaaaaaagacaatccttattcaaataggtgatgatctagctaactacaccactcagtctagaaataagaagagctccgatttgccaaaggaaacaagatgttgttcaactaaaacggtcaagatgtaattcctcacatcaaatttttggattctctgcatttgtgtaccgacaatgactccgaatctcacctttggtgcctgtcagcactccaatgctccccattcggctcattgtgaaagcaaaataacgcctgaaatcttcgaaattatgagcaaactgatcagctatccgccttccatcctcagaggaagtgatctgctggtctattccaagcacgcccaagttccttagtactcgtttgtagtaggagttcgaaaatgtgtagctcttgccggatattggatttaggaagacggtcgggtcttggtgcatgtcatagcattttggctggcatttccccctcagctggcgagcgagagatcgagccatgctcggatcaggttttccggtgtgattgaagttatgaatccgatcatggatgtaatggcagtgagtcactcccatggtgtgagcacctacaaattaaaaggtacagaaactaaaatgaagtttttactagagagataagagttttttatatggtaatatgctgtcacctcctaaattaatcaagcaatacaagtaaggttgaggaatggcaatatacaaattaggttagttatccaaagaaaacttgtcattagcatccaaatgaggttattttaagattatttacatgcaaataagcttatttttgaacaactaactgcgctgaacatttcaagataagttgtttttttttcagaaggttgctttcagatacagtagatgagtagaacttatcaaagtataggaagagaaagatgttagagatcatgtatgttacctaaaagtgttccaaggtcaagcacatccagacctcgagattggaagtacgcaagggcttgatcccatgaaatagaaggaggtggtaggtctaccgattcgacggtggattgcacgccgtcgcgtcttcctgtaaatactgggtacttgggtgcaccagccttcaagcacaacaacattgccataacatcatgtcaatataaaaggtcaactaaaagagtgttgcaacttattaaaactcatgtctccaaccaattttttgattggtttactaatttagttctcttgataggcgagatttgttgaattgattaagttccttgttgaaatcggcggaacttgctgatctgacacaaaatacttgcttgagattacaatgatttgattaactttaaaaaagtaatcttttttcagtaaagagaaaaaaataaaagatgcaaagaaggattccggtcattaagtaaaaaaatctacaatagatcttctagagtttgatgcaaaaatgtctacagagttttttaagtgctcatctcccggccaccggtggttattgtaagccactcagcaatagagtgagaaacaatatgtgagcaaggcagtaaaagcttaaagttaaatcctgtatagcttgctgacatgttacacagtgacttgcttttctccaacagcagaggcatggatatcatagatggaacctgaaacactaaatatgggatttcatacacatctctctagcctatgaatcatgatttatagagttagcatatctctctagcaaatgagtcataatttatagacttagcacttgaagtcatgtctttaattacaagatataattcttttctagcagacaatgttaattgccggacaagctggccttgtcaggtcaaagccaacatatgtatcctttagagaggatgcaagtctaaggtctaacaagcattttcctggtcaaatcaatacagaaccatgtctcaagaagctgagccttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaagcttctcgtcttctttagcatcaacttcttcagatatgtgttctgaattttgaagatatttttagtcgcttattttgttatcattgagtcactcagaaagatttggcataatttgtttgctatttggaaccggcttgcttaagatatcaggttttttttttttggtaaaaaatatatcaggttcatcctggtgttctcgcttgattataagcacccacaaagagcatctggtgattctttttttttttttgggtgcaagtggctggaatatatatagtctccaactgcataatttctttattggaaaccccgtgatagatcctggagatgttgatgaccatggaagtaagacaagtggctgacacaccttgtgagccttatccatcaatcttatgttgactatggatgatgttataaactgtggaagttgatctccaccataattacactgtcatgcccatttagaattggggataagtgctgacagggaagaagtggctcagatgaccgtcagaaaaaagaaaggagcatctatagggggagaatacgatgaactgggggaagtgaagcactccctggttgtgttatatttgttctgcagcaaactggtgggagaagtgctttttggtttgtaacaatgacttcccggttgtgggttatgtttcttctggatgcgatgactcagctgagtataatatattggtcgtctggtcatggccgtgtcaaactatacctacaatgagccatgcttgaatcatgaattatgtcaagatgtgcatatgcctaaaccgaatcattgccttagcttggctatcaattttatttttgactgcaatatgtcttcagttagctgtaggagttttccgaggttgcggagttcctagaaaaaaaaaaaaaaaaaggtaccacgtgattatggggtgtgcaacaagtttgttctgatggaatgccatgtaacaaagttagctcacaggtgatgcgtgaaagagatatatatcaagatcttacctaaaaaaaaaagagatatatatcaggaaaacatttattaaaaaagataaaacggtaagaaatggtcatatatgagcaagggagtgagagggaagcgccgaaggcttagcagcaaaagttaacaggccatgtaccgagaacctcgcaaagaagtgtgcccacttgccaaaagggaagcgtacccagttaccgctagatcttaaaggtttggatggtacaatctcttgcctctttaggcgaaggacggggatttgattccaaaaaatgaccttggcccttgcttcaacctctaattatactaagctttggttgggtccaacatctagcgttggcctcccctcctcctcttcttcttcttctttttaattattattattttatgataattatagtattttatgataattatatcattttaatatgagtacaactcaaaaaattaaaaaataaaaagttttggagatcccatgggcaagtcttgtcttattgtcaggcccggtcttcgacatgcttggtaatatatggtgtaatctgtcgcactatttgcctctcgaaagatatttcgaatatcttggatttagttgataattaggtataatttctctctatgaaaattttttctgctggtaactcttgtttggcataaataatgtctatccaaattgcatgaagctcagttctggagacaaaaggctcaaaaaaaatgtgagcctcttattataaacaatctgatatccagattctgaatgacatagtcaacaccatctttaccatcttttagattactgttgccgttgaaaatcagtcgaggtcggagagaggatggctgagcctcacgcagggttgctggcattggagtaacctacaaaataagtctaaaccggaggttgtagtttcgacgaggatcctccgatgcttaaattagattcaaaaaataataaagcagcaatgagctctctgagagggattgattagtttacataatctttggggctccggtgatttatatagaaagctgtcaaacagctaattatatagctgtgagattgtacgatcctaaaattgcggggccattggacatatcattgtggacgagataatccaggtttcaatcgcttttgcaaaattaggggagtcagttacgcctgagttgatccactcgggatggacagctcggctccggttggtggctatggtggcggtttggcaatttgaagtaatctttaacatcacgtcaatccgaacattcatagcaatcatcaatccgagacttctacagtaactatcgtgataattatcatctaaattaatctttataaatttaaaaaagagtttttaaaaaataaaaaaaatttgataggaacagcatgaaaatcctaagaatccgaaacgtcaagagacaggccaaaaatatcggagcatccggtgcacagatacaatcttaattttgaagaccaaactatttcggaaaatccagatctaatggataacatattgcatcttatctatctctcagatatagatcgacgcctcgactatacttcaagggatcgtacgtagaaaggggaccgctactcatcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggatcatctcggagaatattaaaatcatttctgtttgcgacgtcccttatggagaatgcttttcattgagtagtttcacaaatgctgctaagatgtctgagactataatttctttttgctcatttcatgagacttatcttgcaaatcctttagcctagccacagtgtttggtgaaacttccatcttagttagatttgatctgctgctatgacaccaagttatcaagtcaatgatagatctttgtgtactatatgacagacacacctatagaaaagatagtgtagaagtttagtggaaggaaagtaaagtctggaaatcagttgattgtgtgtattaatcaatcttaccatacaatgatgaaaaaattgttttcaaagataacttccattgtgtgtgtgtgtgtatgtgcgcgcgcacacgcagacatacatgcatgcatgcatgcatgaatcaggtcgaccagatttggacttagatccggtcaggtcaaaactctataataagggtttcacattaatgatccaagctattgaatgtgatccccacctcaaaattgcttacacataaaaatcatatgatttggcgacctttagtctatgcatcaagtagtcaaaaattggatagtctaaataaaattgaattagatgtgttttttgatcatttgatgcataggttaggagtcttcaaatcatatgatttttagtaagtagttttgaggtagtagatcatatccaacagcttggatcatcgatgtagagcttccattatctagttttgatctgatcggattttggacttctccattgtctagttttgatctaaccagatttgagtccaaatccggtcgaccttacccaagtctgcccctacgtatatatatccaatttctcaaagtgaacaattgcctcattatgcagtatcacatgaaaacccaaatagtcaaaattaaagctaattttaagtaagtcctagaaggctagaagtgtaggactcctcaaaagaaaccttaatatgaaataaaaaaagagaccaaaatgtaggagtcctagattcactgttacaacactttgagaatctaggaagtaaagatggggaaggaaacagagggaaaggggtgaacaaattgaaagaaaccacaaagagagggagagagcactgacatgggatgatgtgagctgaggggctggagttggctggggttgggcagacaacgttaaaggttggcagaggggaaaccagaagggaagggcataagcagcagaggccctaagagccttgcatctaaacaatgagaaaaaaagatttagggttagggctttgaaatgggctgctagcacatgcagtgcacatggctcattaaagaacattggatgaattgctatgatctcatcaacccagaagttttttatgcaaaatttaatcttcaatatgttgtttacatgttattttttgttaagaacctatttaccaaaaaaatgtatatttgatctctttcttcaatggcctggtttctagtccttggcttttgaatgaaacaagaattggtttgtttgcatgaaacaagcgtaagtatgtatgtaatgaacataaaggtacataaaacagggcactagtgtttactaagtacacactagggactaaaagttacaaggaacatggttgggcttgacatgattaggtgatttacagtgtgcccatgtactgttcccattttttggtccctttttagctggagtgctcatatcctaagaattgagtataagttggattcgacttctagagctgaacccaacagtcaaacctgaaccttatgcaacatagcagcccacatatctttgctttttatttgcatgatcatagttccagtttgctattatcttagtttcacttgtctcaagctttattaaaaaaaaaaattttgcatcccctcttcataatttgattaattagaaattcatgtttagtttattttatagataagaagttccttaagtagaaacttcaatttaatccaatcaatattgtctccatgaattactatcagatttttatgccttgaggaaggatgttgaagctacagcagaacgtgttgacgagattagagcttctgctggcttggaacggttagaagaagatcttgctgtattggagaagaaggctgcagatagttctttatgggacaatccatctaaagcacaggaaatacttcttgccttgactgatgtcaaagagaaaatcaagctgcttactgatttcaaaacacaggttccaagctcgactccttagtgcttgtttcagcatttatgacagtgtcatatcatgaaagatcattcatgtttcatctgtctttaaattatgcaagatcatcagaatctctcgacaattgtgtttacaaggcaatttaaagtaccctgttcatatttagatccatttgtcattctcctcaatatttcataatgcattcttttgacatctatcaagcatattgcagcttactttattatattcttaaatagttctctaggctatgaagcatggaaatgaatacatgctgtggatgcagcatgatatagatacattgatgtagcaaatgttgggaaaaggatatgatacagctattaaaatccaaataaatattatatttattgcatttatttttcaaatacgtagcccatatttcattcaaaaatatcaaatattcacaaatttcatcatttaattatcatcaattctagagatcaatatccatgtgacacacaatattgtcagcttcaaagattctaaactaactatccattattgaaaggccaaatttcatcaaaagaaagaaagaaaatgacatttcatcccctaagctatccaaaaagtatctgggcatactcagagccttcttctaattttaaagatacctaaagtatgtctgtgaaatgcgtcctagccatgtccaacaattgtaaatatccaatatgtatagctatgagcacagcctgcaattagtattcagcttattgttctttaggagtgtgcagttttaaagatggagttttatcatcaaataattagagcgataggtaataggatgattgctatatatgcaataacagctcaggggttggtggaatcatgaaaaataactgcagccgtgtgcaaatagcaatgatggtgcacaaagttgggaaagtgaggatgaagttgcaaagttgtcagaaggaagtttccacataagaaaattgaatctgcttgaactgttttatcatataccataatctgtgtgcttgctaaagttgtcgagttaaaaaccacttcccccaccaagccccagaaaaggggaaaaatgaaaggaataggaaatctgtggtggttacacgagaattagaggagttaaaagtttacaaggcattcaacttgttaaaaataacatttggaggggaattaattaactattacttatgtaagaagttgttgaaatggataaagaggactaatttcagatgcatgatacaaatgaaagagaccaatgttttgcctttgatgcttttgtttcctgtaacttgatgcaggttgaagaagctgaaacaatagtgaatctgactgaggagttggaatccatagatactagtctacttgaagaggcctctaagatcattcgagaattaagcaaggcactggatcggtttgagcttacagagcttctttctgggccttatgacaaggaaggggctgtagttactataacggctggtgctgggggtactgatgcacaggtattcagttaatccattccttgcattttgtttgataaagtttatttaccaccataattcaaaagctactgactcagccaacaacatgcgcaacacccccccgccccacggctctctctctctccctctctccccccattttttggggccatatcagactgacattttataggcattatgctgtaagtatacaactgatggcatggagggtgagccacctgccttaccatatgcaccatttgctgtaaagtagaacccatcttcactagctaatctgagaaccattttcttttctatgtacatacatgatcataatcctattaacttgagagattttatcaacgatgtctagtaatctcacaggcaaggtttaatataattataacctgtaatataattataacctgtgcaaaatgctagacaatatctcaacctgatgaaactcattatcttgcatgcacttgcaagcttgatacagaagttcagtctccaacctaatggggttatcatagggacgtggttgagcccaagcaaatcacaggagagcctctttcatttatcacaaaaactgaacccccagcaatgcctgttatgtctggttgtgtgcatgtatcctgttacttgctagcagagactatcatgtgttctgaaggtttttggcactcctgttattttgttctttaaatatctgggaaggcatttttcatagtttctgtgtcatactggattaaagcttctgcttacaacacaaagctaatatcttaaacccatatttttatccattttcatgcacacagtcataaactacaaatgcatagagaagaaattctgaggctgtgagcagccaggagacaagatttaccaatccatttgattgttctttacaattgtagctctgaaattaggcagctcaatttttttggccctctagggcaatgtaaagtcaatgtagcttacactttaaaaagcttatttaaaaagaggaagaatatccatcatttcagaagttgcacaggccatgccattcagtacaaggtcaccttgagaggatataccctaaattatcagtaatagaagtgatagtatgacttctatcatgcgacttcaatatatctattttcagatacatcattgttatatttcactctaaaagctagatgggatattttgtgttcacaataatattgtaagactctttgctttatcttcagtgcaggattgggctgagatgctacttcggatgtatgtgagatggggggagaagcagcgttataagataaaagtggttgagaaatctatgggtgaggaagcgggaattaaagcagctacaattgaatttgaagggcgttttgcttatgggtatctatcaggggaaaaaggaactcaccgtattgttcgtcagtctccattcaatgccaaaggtcttcgccaggtaacctaactgctgtaccggccagctgatttgtccttatattagtcttttcatgtcttcaagcaatgggatatgatgagattgatttggagatcaacataagaatctccatctaccaaaataacgttcaactccctatactcgagtagccgttcgcagctccttcaagagccccttcagcctcccattcataattgagactgttatggtgaatctggccgatataatatcctcttgattgtggatgagatagcctgtgtctactcacccaacaatctgaataagaactccatcaatgattaattattggggtagttgagtatggggactcatacaaaaaagatgttataggaggtggagctcaacaggcttgaaatgccccagttgctcagtcaaactctgttacattccttagttttctttcttaatacacccgaagtattctagcatcaaaaattgccagatttgcaatgaatgccaaaaaattcatatgaccttcaaaggccttccatatgaaccaggtggtacttaatgaaccaagcatggaaggctttttccaaggtccaccaaacaaaggaggtagctgagaaagggaactgaggttgaggagactgcaagtagtggaagatgttaaacttagtattttcctgaatagcctttcagcatgcttgggaatggttgtgaaggaaacgaggtgttctttactttcaaaattttgcaagcacatctacatctatcttgggagacatttaacctttgtggttcaaataggcagttgtggtagcctcgagtaatagactttcttaagaactaagaagtaaattaaatagtttggtattgaatttattacttatttccatgtaatgtgactctttggacctgttggctactgaaggtcttatgtgaatggacatcgtttgcttccttatagtgttacaatgccatattgcgctttctaatatgcttcttattaagaagttgaagaaacatgctatctaatatgcatttcaaattttgatttgatttttctccttaatagattttcaagtgtgattccaatttggcaagacaattgatgtctatcatgtcaagtctaaaggatgaacttcattaatacttgcagacaagcttcgcaggtgttgaagtcatgccccttcttcctgaagaatcattggatattgaaatacctgaagaagacctggaaataacctattcaagggctgggggaaagggaggccagaatgtgaacaaggtggaaacagctgttcggattgttcacatccccactggtgtcacagttcgttgcacaggtttgttttacactgaagtttagatggcagtgcattctttttctttaattgttaagtgaaagacattcatcattgaactcaataattgatgaaagatttgcatgaaatgaaaacggagacaccatgcattttttaaaagagaatctcctttttgtgtttagttgactccataaaacaaacaatatattttgttttatatataaattaaggttttaaagaaggtaaatgtcgagggtcccaacttgctgaatggatagggtcttgtgttggaacaactgaacaagagacctaggttcaaccctaccctcgtgccggtatttggctggtcttccaaccattcctagtccttgaaacaaaagagtaaatgtggacaagagtgcagcaacaagctttccctctatcatgagaaaaaaaaaaatgctccagagagtccaacctattggtataaaatccttccgataccaccaacttaaaaaggttcagccaccacactagtctgtgcataaagcataaagaaaaaaaagcctgacatagaaagtccaaaagttggaatactgttttgtaccgtcttccttgcctctcaaaacccttgtggagtatggtttctgtatatgcaccatcttttgcaggtcatttaagttttcacgtacggtttttttttcttgaaggaataagaaggatatctccatatatatgtgtaatgttttgccttccttcgttaaagagatgcatcaaaacgtataatatctatcaacaataagtttcttgcttgcacacacgcacaaaagaagaaggagaagaagaaagaaagaatccataattttcaccttgtatacattcagaaagcacaattcagtaccaagaaatgtgttagcaatatttggttatcaaccaaaaagtggattagcttctcaaatttacaacaggactttcagaaatagcgctgatatcatgtgatttaggtaaagctaattcatactaagatgggacttatcttgctgcataatttaacaactggaaaacataagaaaaaaataaaaagaataactgatgccatgtgattttcctaacatttggttgtcctccctgctcaaaattcagaggaaagaactcagctggctaacaagatcaaggctcttagccgtttgaaagctaaacttctcgtcatagcagaggagcaacgagcctctgaaattaaacaaatacggggggatgcagtgaaggctgagtggggtcagcagatacgcaactatgtcttccacccatacaagcttgtgaaggatgttcgaacggggtgtggaacatcggatgtcacttctgtgatggatggagacttggaagcatttatcaaagcttatctcaaatacaaatatactagtagcatgggtgaagggaacaccaaatgataagattgttcactgactcctgtcttttttcaacctgtttatttaagttttatccttcagtatgtatatgcggagtctccaattttactgccaaatcattactacatttctcacccaatttttatgttatcatagttatgcttgtggaattttaatctaggtatttatcatcaggtgtcatgttctctacaaagaagacaagatttacctgcccctaaaagtagcaacttagtcttcatcacttcatggtaagctccactctggttagaaatttctcggtatagaaattggcataattttgaacagttgtgtcaggttgaaagccagttgtgaacctgatcaaaattcaaaggattgccttgaatcttgaagccagcaccttatgagtgcgataaatgctgttggcttgttgatcggttctcatgctactcttttcataacatttctcacgatcaagtgtcaagagtagtatttcaagcacgagaatagcattagtttttttttttggtagtgagaatagcattagtttaatagtgtgtatctagcctggtctaaaacatggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacgaaattcgtcatggagttggaatcttctagccggagcggtcggtgaatggagagatcgccaccatgatagaggtccggattgctgatccgaatacaggtcgccgcacacgtcgattccgctaagcatggctcgccgccgggggcgtggtgaaggaaaaggtagaggtggcggcggccggcgggagaagatagagatgggagtttcggcaggtccggaagcaagatcggcatagaggagagcgtgcgaatgggcgatgtggtagaggagacgggcgcggagagagtaggagaggaagaaaaattttttttaaataataaaaaaatattatatatataataaataaaataaaataaaataaaataaaataataataataacaaccgagaaaataacgtcctactccgcaacgccgcacttgttcaggtaaccgtcgagccctctgcttcattcttattttaacttttcctaatagtgcttcggggcccaagcatgttaccaaacccatggagagccccgtgccatacggcaccggaggagcatcggtgcgattcattgggaattacggaactactcgtaacataacacgtggcggtagaaggttgctcgaagctaagtgtggaagacgtgcttggcatcacttttattttctatttttaataataaaccccataaacgaaaataaaaaacatattagatactattattttatttttaaagtataaaaggtaaaataatattctaaaataaaaaattaaagctttttaattttacgaccgctacaatcagtaatttcatgattctaaaagatgtaaaaaatgaaaatgatgcctaaacgacggtctaaatttttaatcttttatttatttttgtagcagatggagacttctggctttttctttaatgaaactggagagtatgagagagattcagagtgccagaattcgtttgtctgtgccaagtctgggctggcagctccgttcaccatcgctgctttaatagagagagaggagaagaggagaaagagaggggggagagagagagagaggagggggtgggtctggaagtcttctgtggtcgcttttatggattcgaggacgtgatctcggttgcagtgtaaacggtggagagtggagaggggagggtggtagggagcggggcggttatcccagattcggtcgtatcacgggaataagggttttaaatttactcccgctctattctcggctcgtgccccgccgaattgggattctacgggggtggttttccgtcgctgtctcttctggcgagccgatttatgacggagaaagggaaagatcaagcgcttttcggtctcgatatcgggagaggagggtccttttcgtttcgttccggctccgggtattggggattgggagtttccactggagagcgcaaaaaggttggcgcttttgatgattttgtgccgtttttcttcgttttggatctgtaaggagatttcttttggtacaatatctgtaaagagattgaaagagcggttttaaatctcttcttttagttgattttttgatgtggaattgctgaacagtctgttattcatctttgtgatctctgtagcttgaaaaagatcttttcttttccttctctgtgatctgattgagttcggcaaaaaattgtgaaatttgttcaaaagatgggatttttgcatccgggattttaggaaaacgtgctcttttattaaaccgcaactttgcttcgtttctgatggtatgatccggtgcatcagatcgaaaagaccgtcatttactgtgaggaatgtctctggatttccaattaaataatttccttccgggcttctagaaccaaatcttttcttctcacatctgtgattcagtcaaacccctgaagaaaaattttcccttctatccatcgagtgattgcatttttatcatcgtcgatcgcctcaatgtcgaagtctttgttgtcctcacccgattctctgttgtctatctaactctatgattgctttccttgtcttctcttttttttgatcttcatatatcctcacatggtttttactgggaactgtgttattctttatgttctgtaaacaatagtggtcccttcattgtctcaatctgatctatttggaccgagtttgctttcaaggcaattctctattccttgttttttaagtgaggaatggacctattccctaaattatagctgctaactgctaaacttaaaagcgaattttttctggtacgggcccctacaagaaatatctttcccttgaataccttataagcttgtaccttgtatccagtagaagccagcatcatattcattcggttcgaattagtcagaaaattcttggctttatatcttgtttattgcatggtaaagtttttattttgcagtttattatatttttgatttgcaatggttctcgcagggactatttctgatagatttgagggtctctgtgtgtcactattttataggccagaaaagagaaccctctaaagcttgcgttttctgtctagtttttttaaagaatgtttctatcttaaattctctgatgattcgatggtttatattctctttgaaggtgaaatctctatgtaccaatcgactcatacctaaggctccttattttcaattctagattttgccgatcatcaacattctattacaatttgtgacagatcctgcagtccaaaattttcatatttttttctgtattggttatacatcaatagttggaatctatatagtgacacatggttttatcacaatcttttgttgatttctgttatataatagatttgatctattctgagtcaacatcttttttattctattctacctgagtttgctttcaagccaattctccttccttactctttaagtcatggatggattctatagttctatgtcccaaattattgaatgaaaacccaagaaattgagatgtaagtttctttcgtatccgtccctctgagaatttcatttcttcagaatagacaatgtttttagcttattgaaagtcactatctttgctctacccgagttttccaagtttctttcttgtcagctgcatggaactatctgattaaaaaactaaccatcacatttatttctcaagagggttttgctgtttttgcattttattctagttttcaaagatcctgggaacgatgcaatgaatttagttcaaacattaggtttcctattttatttttttagagcatctgaagtcttaaactgaacaaatggtttaatgtgataaattttttgaacctctgaattgatctggaatctgcattctcaaagctcaaaataattgtttgcttgtctcgatttctctgttaagtagttttattattagttgtggtagatgatgtgattcaggtagttcattgccttttggatatagatttcatctaatgcttaaaaatggtccatcagatcgctgttgctgagtattggcatcattaaacaattcatcgttaccacctgcaggttcattgaattccttccaaatgaaatgcattctaatatcaatttatttttttcttaaatgtttccagtgtaatgcactttaaagacagcaccaaatggcttcactggtccctggggtcctccttaagctcttccagcacatgaatacagatgtcaaggttgccggtgaacaccgctcgtctctccttcaagttgtcagcattgttccagcccttgctggcagtgacctcttctcaaaccgaggcttctaccttaaggtctctgattcttcccatgctacctatgtatccctacctgatgagcatgatgaccttatcttaagtgataagatacaattgggacagttcatttatgttgaccgccttgaagcagcctcccctgtacccatccttaggggtgtaaggccagtccctggccgccatccttgtgtaggacaccctgaggatattgtggccaccagttccctgggtttccttggtactgaaaaacctcggctgtctaatggctcaaaggatgatgctaaactgtcttcagaaaaagagaagaacaaattggggaaacagaatggaactattagaactgaggaggttgaaaaggaaaaggcgctgctcagtaagtcaagctctgcactctcgaaacaagcagcgaatggcaaattggagacaaaggaagctatgggtgtgagatcaagatcaatgaactcaaggtcaataccttcatccccgacaagtgtttattcattgcctgcatcatttgagaagttctccaatgatcttaaacagcaagcaaaaattaaagggctagaaaagccagcatcttcacagttggttttgttggagaggacagcatccattttaaaggttaccacagctggcaggaaggcagctgctggaaattctactcggaatttggtgccaggcattgaatcaagtcccagggctttgagaaggagctgggaaggaagtatggagacgaaagggagggttcattctaactcaaaggcaggcaaacttgagacaaaatctgagactcgaagtgcttctgtgagttaattgagactctggattcattctcttgcatataaattttgaatcctctttctgcatcttgaagatgggtaaagctagcaagcttcttttgtttttttggtcttttggatcttcaaattatgatgtaagtttatttagataatataatgaactaaattgctagttaaatgattgatgttgatgatatctggattgcgtcaaatgactttggcttatgttgatcatgttagataaaattctgaaacagcaatttggtggattcttgtcctttttgtttaacttgtctttctatggatattacaggagttgttgaattttgaacaatcatgtcagatatgtttctaactaataatttggttgagattctctttgatttctgcaaaagtaccaaaacatgcctactttttttcttctttttatttttatgtatgcttgtatcctggtggttggttatgtttctgcttattgatgtgtcacttaatcagcaaagtgtgcacggaaaaaaaaaaaatggtttcctctttcacatgctttacataatgcaggatttctgggtttaaaataagtaacatagcctggccttatggatgataatttatggagtttgataattataatcattctttttggtccattatcattatgctaaattattactgtgttttttattgaaggtttcatttgcatggattcctctttcattattgttagataaaactaaaatatgaaaattcaagttgctccatggtgcttgataatccatataattggaacatcttattctttatttattcacttattcaaacttgcaggttcctcgaataaaaactccatcaaatgagaagtctttatgtaaagaggataataacgttcaaactcctgtgaagaagggaactgcaaatgcagcttcagatgattcggataggtcaaataaacaacgggcttctatcataaagaagacacaagaggctactaacaatcttaatctcgctagcttagtcaagtttgtctctaatagcaaaagatggacagatggtagtgtttcatgggcatcacttccatcatctcttgcaaaactcggaaaggtatgctatgtaatatcatgtaacatgaaaatttcagagttcttattagaataggtgggttaaaattgttgcacatcagttttttgctcatacatgaacattatgtatcttctatttttagcttataactatcatcatagcacatatataacaaccatctcatgaggtcttgttttttgttattaccatcttatggtaaaccagcctggtcggtatagctatatggccttctggtaaaccaccttattgtgtatgtattagacttttgcacactgatttcttacttcactggtttagtgattcatttgttctgatgtttatgttttatttaggaggttttgaagtatagggatgctgcacaagtagctgctattcaggctttgcaagaagcctctgctgcagagagcttgattagatgcttaaggtaattacctgtatttggtaatttgcagcacttctccacttgacaagagctgaaggcattacacttcaagttattttcatttatacttctgcatttaattcctatccacatttttcttttatcctaaacgtgaattcatttgagcttcttcctgttctactatagaagcgttgatatgaatttttctattatgctttgctatcttgaagcaatctgctccatccatgataagtctaatgtaacataacagtcttgcacttaaccatatgcccacttattttgtaagcctacttagatcttgctgtctaacgaacaaattctcctgccactatgaagttttgatagttgatttttttcagtattttatgatctattctattaatttgagatattgaggctctgtgagacagatttgcaggtgcttttgaagatggtccagaaacgagttttatctcctcatagtatgtttgatcttattagtgtagttgctagaactggttgtttgagtgcatattgacactggttaatatattcaaacaatttggtgtgtggatctgcttaatttcattattatgatcaaatttttgaaaaataaactggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccaatttctgaaagaggtaccatcactctgagcttgacaaagagtatttatttgcaaatttgtagactttgtaaaggatggcctgtgagaaaatggatttctcatctttatgtgaaggcagtatggaaactgaatatagtttgatccttgagattatcttggagaataaaatctgtgtacggtttctttcttttccattgtttaactcctacaatgttggctcattttgcaagtgaaatatgtcatttagaatggtaaatatttgtctatcatctcctatttcacttgtgaaccacatatactccaaaagaacggcattagtagctaccactaatctttaatgtttgcaactttgcagctcttcaattgctaaaaattatcgacaaagtttacatacccacagttgtcaaatgtcttgcacttgataaaatgccatttgaaactttgctgtggtctttgtaatttttttcttttcttttcttttttccctcccctttttgttcctcacacactgacgaacacatgtaggcactgataaattctgaactgaaactgttgcttatagggtgcatttgcttgcagcatgtacgcagaagtaacgtccaccgcgaaggaggataacccccagccggcggtggagcagttcctagccctccacgcctccctctcccgcgcctccctcgtcaccgactccctcgccaagaatgcggtaacctcaccggaccaggccccggcgggtaaccccattccagaggaatccctcaagatctgcgccgacaagcgccggcgcgccaacacctgggtccacgccgccctcgccaccgacctctcccccttctccctctaccaccacaagccccaccttccgccgctctccgccgccgccgccgcctccacctcgttggcggtggtcctcgacggcccttccaaaaccacggcagcttcctccaaggccaaatctcgggcgcctccgcctgcagtgcctgtgagttctggatcggggaagccgtcgccggctacgacctccaatgggaaggcgcggggaacggcggccccgcggtcaccgccaccggagtgggctcgcggtggagggctggaggagggggcggagctggcgcgggtgctgagtgaggaggggagggggtggttcctggggttcgtggagaggtttctggatgcggacgtggcggccccagggccgtgggatcgggagcaggtggccgggatgctgtcacagctgaagaaggtgaacgattggttggacaggatcgggcggcggagggaagggcaggcggcggaggcggaggacggaggcggcgaagggggaggcgtgccggaggagacgatcgaacgtctgaggaagaagatatacgagtatcttctcgcccacgtggagtccgccgccgtcgctctcggcggcgggagctcggccgcggcggtaggaggcggagggcggcccggccggaagggatgatcgaatctgttgcgcgaatctcgatgcaagttaaagtaagtgttccccgccgttggattcgtggcagcgtgacgattaccggggctagtttacgtggcatcctgtgatttttctgttttcattgttggtattatgggagcaggctaatttgaggagtgcgtgtacagattggatttctgtgagggtgctggttgtgttctccaaaagggcgtatgggagatgagggataagaaagggagattctggtgtgtcttttttttttttttgggaaaaaaaatttgaaagaaaaaaaaaagacacaaaaggaggaattgggggcagcttttgatacttgttaatttttttattcttatttttttgccttaattattgtatgaaattgtatttatatgtggtgaatagttgaagagaggtgcactgttttgcttagtttctgggtttttaatttttaaaagtttgtaaatgtttctgagctttaaaggcaaagacataacaattatgtcatttttttttactatctgtcaaatttaatatcaaactcatatattgtaaaacattctgtgattattttgcttgctttgtgtgtgtatgtgtgtgtattataagttaagggtgagattgaacctagataactagtgatttcaacaagactacagctgacctagctagcacatgtcgaattagatgatatgttatattagaatttcaatggagtcgcaagtgatttcaattatttcaaactaggttgacatcgttagcaaatcaaaaataaattctgcatactcttctctcatatcaaaactattaattcttattccccatccatggtacgtgctaattaccctcgaatgcttcacatctcgtgacctgagttttgatctgtgagttgttgcaccctttcttccaaactgaagaagctatggggtggaaatttcacattcccttgtctgcatcagattgggtattctatcgagtgggcttccctccatttctctagccctttcaaaaagacaaaaactagaacatgatttgttttgtgcgaaacgtctaccaagcgatatgtgcgatagatctgatgaacccgttgttcaacgaagcatcctttgaagtcagtcaatgccctttttttttggttaagaagtcagtcaattctttgacctggggtcgtagaacaagacctgtactgtatgtccacttcttgtgaaagcaccctcgcaaacatttgactccccattggagaatccaaagttggtcctctgaactcccatggatttttgtcgaaactattacacgtaattttgtgcacgtgtcaggtaatggttggtccatgaaagggtcgtggaagcattttgggagctgattcgtcgaaccggagccgattttggtgtcatccagcgagagaggatgtgggttaagaggagtggacgcagcccggcgttttaagtctacatccacggagactgggcaagtcgtccatggatggtgggtcccggagtcgccggtgactaatatttccacggttggataccaaagcgcccatctgttctccaagaaactaccgaaatatcctgcaaactagaatttgcatgtgccaggcacgtgacgtaaaaattgacatcattttcccattcgggggaatccgaatctaaacactgccatgtgctatactttttctctcttccctgttttagtttactaaagaccgatgatggtgaattaaatcaaggtaaggatggcaatcaaactcatgtcattggtttctaattcctagattccagtaattttagcaacctcacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagcgcttcgatggtatctaccaactcctcacatttttttcccaatttatacctatttttgcatgatattaagctggtttcttgatgcatttatcgctgtttttcttcgcagcaattgatctttccatgatataaaacattcagttcaagaaaaagtattaccatggagtttttctaactattctttctttaatcttcatgatgagggactacgtctaaattttcctttttctttttttaaagaatcgttaagcaactgctggtttctaatttggcccgatctttaggtttctgatgtttacttctagagtgatgcttagcttagttccaaatgaggcatttaatgtttcaaactttcctggttaagtaatggcttttatttccagctggagttgtttccaaaattgttttgtcattaggtaccgtgttagtcagttcatttacaaggggggatcagatgagtctaaagtggtaaaaaaagttattttaggtttttttttcttttttcttccttccttctgttgttgtttgtaaaataggttacgatagatcggtttaatccattctgcagcaaacactcgcagtaaattatgcactatcaatgcatgaatgattttgcacaatccaaaaccaacattaggttgagaaaaagaggatggttattgtcaggttgacaaccagttcttgactaggaaatcctagttttaacgctaatccttattcgcttgtaagcatattctagtggaaactaagtttaggagctgatgactctgaactgatcagttatttggtgcaagatttgggctacaagaatttagatgagatgcactgaaaaaggtcacaaactgcactataattgtatcaggttgttccatatataaagttgtagctgattagtgattgcatacgtgtttgatgattgcacagtgtttcttttatcttctttcctatttttgacatcacttcataatgacttatatcatgtatatacatctaatttgattggctaacatagccttgttgtctttgtatgtggttactgaaaagatggttgggggagacgttgggtaaaatcagactggaagaagagtgaaggaaaagctggttcctttaaacacacggcgggacaatgggctggagatccagatgacaaaggcatgtttttcttttttcttttcttttttttttgtcttttttgtgtaccttgaactttaactctcaactcgttgcttctattatggtgaggatcttaacaagcacttttgagttctatacaccagagaaggtatcaaataagtgttgtaatgatgagcagaagctgattttgaatgcacttgctagtttttcctcagtaatttcatttttgctctgagcatatgcattttctgctggtggtcaattcaggtatacagacatccatggatgccagacactttgcgatatccgcaaagatcccagagttcagtaataagaacagaacattggtggtccaatattctataaaatttgagcaggacattgaatgtggtggtggctacattaagcttttctctggttatgtaaatcagaagaaatttggcggtgatactccatacaggttagctgcataatttcttcaaatgtgtgatatatgttttactccttttgattttccaacattttgaaatatctttagctactatttacttatattttctttggatcataatttcagtcctccgcagacttttgtgctatcattgaatgaccataaaccctgtgattagattttgtaccgttgccaactgaaatttttgatgcattaaaggatgcttgccctgtaggactattgttgtctcatttgggagttcacattatttaggttcattaaaactaagtatatggagaaagaatgtattggagtcacgtgaaaacagaactaagtgaattttggagctggtgagctttcttggtgcactatctgtctaccatatttggtggaatccttttctgcagcaatatgatgagaattatgtttcagtgttggccatttgggttataatttttgctttattctaaaacaaatgcagtctattatactaaagcttgcttactttcctttgcctatccttatttcgagttcggggaaatttaagggtggctccttgattgcataaagttaaagtgcaaaaactataaggtggtgtttctttcttctagctggtcttctagttttctgatggcaagctttctcttgcaatgtattgattggctaggaaatcagtgccatcttgtaggctgctgatgctagggtgggagccaatgatatacaactttcaacttgaactggatagagttaaaactctgcggaccagattttctacttaagattaaaattttcttccaatctgactggactgtcattttcttgtgcactttgtttaattatttgctgctttgcagttttgcaatattcaacatcttgattatttgcatttcttttatgcagtttcatgttcgggcctgacatttgtggctcgcagacaaagaagctccatcttatcctttcctaccagggacagaattaccctataaagaaagatttacaatgtgagacagacaagttaacacatgtatacacatttattcttaggcctgatgcctcatacagtattcttgtcgataaccgagagagagattctggaagcatgtatactgattgggatattcttccacctcgaaaaattaaagatgtcaatgctaaaaaggttggtgcttgctctatcatctcgtgctaccatattactgataagtaaggtctacaatctatggcatcgtgatgaacacttattttttctttttacaaaaaaaactaatgttgcagcctaaagactgggatgataaggagtacattgatgatcctgatgatgttgcgccagaggtttccagcagactcaaagaaatgttttccctcctggacgtgcttattcttgttcttactttttatctataccttgtagggatatgattcaattccaaaagaaattcccgatccaaaagctagaaaggtatgctcgttatctttgataatgtaagatgaaattctcacaagcatttggcttggcctgcagagtgatcatatgtgccttcggtaggcttttttttaaaaaaagaatttccaaaggaaaatacattttctggttagtgaggttgaataattttgttacttgccaatcagcctgatacatgggatgatgatgaagatggcatatggagaccaccaaagataccaaatccagcatacaaaggcccatggaaacgcaaggtttgtttgctccactatgtctagttttagtgactgaaatctcacaaatcacaattgactgtagtgatatatgtttcttatctatgacatatattatgaaactacagaagatcaagaatccaaactacaaggggaaatggaaggtcccatggattgacaacccaggtaagctgagaattaaatcagattcattctcttaattatggtaaaaaaggaaggaaatagttctaacaagaaatcccttggcatatgtgatgttcaaatatgttgtggagctttggagcttatctgtgtatatcttgattgcacattaactacattcatatgttcctaaaagcttagttgcttgatatcaaccatatgtcagtctgacattccgagttacttgaaatggtattcaagtgaaagtgttcaaatgcaagattttactttgcaacaaaaaggattttaattggtgctactgcttggcaaaaatacctcagaatcaaagaactaatactgaaaatcatatagtttagttgaaccacttaaaaatatcattattacttttcttcattttgaggcaaataatgaactttagaagaacttcagagtttctattctatttgtattctttctgtgcttaagcatatcagcagagaactaggatagcctctattggttatggtttagtttcaattttcattttcagttaccatttttttatatgcacccatgcgcatgtgtgcttgccttacaatggtagtagcagctgtcatagcatcagcggtattagtgtaagaaatctaagtttaaggtcttggttggatgcatgaacatattatccatgtgtagcctagctgcatggtatgaagtcaatgaacagtcagtatatgggagggaaatttgaagggatcaggagaggaaggagattgtggaccacacgttccctatatttctagggatatagtaaatcacctttttcatttgaattccttattctaattttgaggagtaggggtgtctgcgaccataaccaatccctgcaaactctcctcccatgtatcttgctgctcaacaatgttatcttctgtggggaggttagacatggataatacattcaaagaggccatacatctccacagattttgatattcatggtataataaattttaagagcttgagaagctgaatgcaggcaaaagactttatttttgaactgacctagatcaaggaccgcggaacgagaaccggaatccatgctagccggccagcaatgtggttcagtatgggtccataccggtttgtgctgggctgaaccgatggggcaaagaagaggagagggagaagaaaaagagaaagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtacagccagcccccccccccccgcgtcagaatttgaagatgatccagatctctatgttctgaagcctataaaatatgtagggattgaagtgtggcaggtaaatcactgtagcgttcttgcctaattcttttcactaaagattaacggataatttgccacaaatgtttttaactggacattgatttaaatgatacaaactttaacatgatgatgtaagtacaggtaaaggctggttcagtttttgacaacattttgatatgtgatgacccggagtatgcaaaaatggtagtggaagaaacttgggcgaaaaatagagaggtgggctcacacctttccactgttgctgtaaattgtccttagatttcaacttttaataaatgctataatcttttgctgaaaatttcaggctgagaaagaagcatttgaggaagcagagaaagtaaggaaagctagagaagaggaggtatttattaaagagcagcctactttattcgaaattttttcttgtatatctgcctttcataagcgagtaatgctatggggtgctggtttagttcatataaaagttttctgtcacatggcccagggtattggtgcctctgttgagaattagtgcaagggatgactgagtatatagttgcctggccagcattagtgggtccaaccaactagtcatttgcatgaaaccatcaccgaaagcatttttcttaacaaacgcttggcatttctaagacattatctattctggctctttctgcaggaagctcagcgagcaagggaggaaggtgaacggcggagaagagagagaggatatgatcggcgttaccggggcagggagcggtacaaggatagatatagaaaggtaaatctcaaatctctttttctcatcaaccaagctttacgtgtgccatagtgttcaatttttaattatgttcttttccagagccacatcccaactccaaagaaaaatatcaacactcagctcatcttttggtagcttaatttttgagaggaaacccattgccatcagccaacattgttgtgtttcttaaacatcatcaactttcggtagtcagattaacaaaagtacaatgaatatattctggcatgttcctgattcttccagctacttttgtcctgtctaaaatatcctgaatcattcttgtcttatcagttaaaacttaatttgttggcaaacacgaggcttgggtggctcgttgaattgcagtgcatcttttgtaaaattccaaactgttcgaatttgatgtactggatcttgggtcataccattatcaaaagccatttgtctaagcgaccttcattgtccaaagttgaatgcgagttgcagggtagagtttaagatctgataaacttcacaaacctctaggacttcacagcgaaaatctggacgcatcacatgaaattccaagttgtgttaaacatcaccctcatctcttttgggtccatagaaactcatgactcaactatctttctggtagagatcattagtaaataaaggccagatattttgttcatttcgattctttacttcgcctactgtacgatccaaaagttttaaacatttaagtcctcatgaaattcttataacatcaaaactctgaaagaatcctcaaggctaatgatcttccagctgttaccgctgctaattagaggcgatggttcaataaagcctctaattgtatttcaatgtagattgtagtactttcaccgctaaagctaaatggttttctaatttgaaatctttatgtgcagcgccgcgattatctggatgattatcatgtaagttttcgaaggctggatcagaattattctcatcttgttttagctgcattagcaatttgtctttttggtatgaacattagcaatttatttatcatactaatccctgtatcctaacacgataacaggatgaattgtgaaagccatgcacagttccatcagggagacaatggaaagagacatccatatatctttttgtattgttagtattggggtttgaccgtcgcggactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatgatgatgaggggtccctgaatgaaagttgagtataagttttgttagtgtgcaacaatttatgaagaacttagaatctcttgtcctgcaggttaccatccattggtaaagaccgggtgtaatttggacctctggctgtgctgtgttgtatcagtctctgtactttgcccaacaatggccaaggaaaaatgttgtattgtccacacggtggaaaaatattgttcaaaataaagcttgaatcttggggaaccaggtacttggttgcttaatgaaatcatgacactccaaccttcgtgcttctttttgtttcgtcagcagtatatacgggattttattttatcagacgtccactaaccaaggtttcgtctagggatttctgtagtcgtttcaaactacagccagattgacttgcatacttttctcaaaaaaataaaaaaatgttcaatgttatatgtaacttgcgtccaatgttatctggggaaaagaaacttaaaaaattttggactggagagtttaattttgacctctctgagcctagcaaacatcagggaggaaggttactgaaagtgacatgcacgataaagggctgtccacaagcattttgatcaaggatgttctttcctgacatgaacatgtagatctaacccagcatgaggtcaacttgacgtaacatcgagatgtaccttgactgcatgttttcacgcattcctacatctttttccttacaatattttcaattattaatcctaccattgttgtctgcttataaaatgttgttatatcgtcgtgcttgtattataattatgcataccggtatttaacccgcgcattgcgacggtttaattgatattaataatgataatattttttatattatgaatattaataaatttaaaaattaaaaatactataaaataaatttgtagaatataatttgtaaatatcaaaaataaaatataaattatttgatataaaaaaattattttttttgaattttatcctgacaattctaaagcatgaattcgcagcgtaaagcttagaagtagcaaaagaaaaaaaataaaactcttaaaaaaaaaattgagaaataacaaattagtaagtctattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattttctagtataaattatctattttgtattattttttcatcttcttttttttttataatctctttttacgtaaactatacttgaagaatttgttttccctttatatgatggctttaattgcttgtgcgactcttctaataagaatacctttttcaggtaagaggacagccttgcatgtggccgaacatgggaaaacactggtttggaaaacatatattatatagttttgggactctatttttgaggcctatcaagactttgtatggagggtatcatgcatatggtgttgctgggcttttgtgtaatataactaatatggcatcttctttgcaaattgaattggtgagttctcttgtacttttagaccttttctattggatgtcttctatacatgttcagagcaaagctattgaattgttgttgttgttgttgttctttgaactcaaacagactcaatgctgcaacagttcaactaaaaaaattcctttccatgagaagctacatgggaaagttatctttaggacttttggcttcttttattaagtctagaagttaagtcttaacatgtgctttccacattttattccttcctctaaagattcttttaccaaaatcttgtctgttatttctttgtatatatttctgagagatccagttatttgtgcttctcatgcatcatgtaacctgtacagccgtatataaccatctatataatgttggcatcaatgtgttgttttctggatcacaattttagaacatggtttttaagaatggagatatattaaaataagatggggcttggagcatgtgaaattacaaaaagtgtttctttagattgacattatgccaaacatctgactggttcaacttggatactgttaagttccttcagaatatttagtcatccatttgcttctcaaatagttgggttatatatttattcgatgctttgagctagactgtgatgcctaaaccaactgtacgtatccatgatatccatagcaataaggccatttgccatcatgatgtggttggagctgtcactttttgacagtttgtagatgtaggcaaggttttaaatcccataggacaaaagtgtcacggttttctcatggaatgggatgtcccattgtcccatcttattgcaacaacggtcccgatcatgcatcccgatggctatcttttatctctccccttcttctttctttctttctttctttcttttttttctctctcttcttttctttcttttcctctaccttcctttctttccttttctttttcttctccctttttttctctctctgtcctttcattatttacttttcttcatctctccttcctttccttctatcctctttcttcatctcttccggtgtggatgggtttcggtgtcttgagcccatcttgatctcattttcttaggaacggacgggatggatgggacgtcccttgtctcactgggacataaaaccttggatgtaggcatgtgtactgttcatactcattcccccatgtgtatagccatgtcccgggccatgttgaagggcttgatacatgatgaagttcaagcagtcctaatgactctaggatatggttcctaatgatacaactactctgtcatctttatttttcttgatccttagtccatgttgttcatctttatagttctaaatgtcattgcatctcgtctaacaatattgaggttgcattttcacatggtgtagcatgactgatccttgtcaaattgttttgcccaccctgtaatcttgttcctttctaatagcacaacatgctgctaatgtatttttctcttttgatttatttaatgtgatattgttcttttatttgtaaaaataatagttttatataattcttttttctatttctgtgtcacctatgtttacaaaaaaaccatcttggtttcagcttgaggtagttcattgtggtcctcgtaaccttcgttgccatcaagcaactaagaaagcatgtgttcattcttcttatttccacaaaaagttgagctcatactctatccactgtttgcaatgcatatctgatttttcccacccttaatcacatatcctttgtcatcatgtagaataacattgcacaattaacatttgacattgttatcattatatcctttcatattatgagttgcacctgattgtaattccctttttatagaattacttgaatctgtgttaaatatcatcctttgcaacctgctcatatttttttcattcttctggcatcctaggcaaaatttcacttttagtaggtgtaccgttccattattccaaggtttttttccccctttttcaagattgtgggagagacccccttgacccaattatttaaccaattgactatttacacctggaataaatgaggttaaaggagaggagcaggaaacatggtcaacccaccttttactcacttttgcctggttaacctaaataattgggtaaatttactctgtcaaaatggttaaatgggtttatctggttaatccctccatttttggtctgaagttattcatagaacctagtcaacttggtttcatcctcctaacaccaaaagggcctcagagttacatttattttatgtggtgtcttgtcaatcatttggctaaattatctatacatgttttgtacatcaatctgaatagtctaagttgtgtatggcttgttatctaaggtcatccctgagacccagaaacccggaccctagttgaatgcaatctaaaactgtgtacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttggatatttctttgttctgttgattgagcatgactcctgtaacttaggtgtcatatctaaccaaactgttcccacctagagttgaagaatcactcagacagatttgataaatcgacaatcatgtatgcatttatgtatacatgaggggcacaaggttcatgatcaaaacttgaatcaccattttggtttgaaaaatttgaaatgcactctcaatgtttatcttttctttcctcatctattatcgatcaatttttaaatttaaaacaaagatcttcatgccttaagtacaaaacctcccaaatggactatataattttaagccaaaaggtccttgttcgtcacacttagcccgtttggatgccagaacagcttattcctggataagatcttctggttgggttgaggtcttgagaaaataaaatatcgatctatgaaaaatttgagaaattggtagaacttcggaaccgattgtcccgatattttgaggagaagataaatcacctatttctcagagaaagttatccaaacttttaggagtgaaatcattgacaacctccctataatattgggactcttttccagacttactattttgattcttcaaactctcattttgcagataatattcagtgattaggcagtccagcatccaaacaggacctaaagcccttatactactttttaagttctgtttccataagatttctatgaatattcattgaaaatttgccatgacttcttctaattactttatttggctctacaaactctatgacatgaaattttcacctttcttcaattaaaaatttctcacgggcttgaaacatggaaatagcctctccacatgtagtggtatggttgtgtacatctgaccctctccggaccctgcagtggcaggagcctagtgcagctgggctgccctgcttcaattgaaaaacctaacctggtttcagaaatcttataaaattgtcaagctggcatatatttcggggatggtatgcgtgatgcttttgtaaattcttaatcttcaagaatgggcttgtaacgactgtagaaaatctgtttttacaaagtcattctcagtagatagtgctgtctgcttatagttgactgatgcttcatgctcatctcttaaaggtatctagacatggaaaccaatctcaattcatgtattcataatgttaatttcttgtatctttttgctaggtaccctgcctccaagataattatgcatatcttttgcatgacacggatacaggtacggttggagttgtagacccttctgaagctgttcctgttatcaacgcactggaaaggaaaaatcagaacttgacatatatactaaacactcatcatcatcatgatcatactggtggaaacttggagttgaaagcaaggtatggtgcgaaggtacgatgcagttactttattttgattttagaaaagtagcctagatgacaaatttgccttcttgttttctttgaaaacattgtccttcaccacttctatgaaaagagaatgtttatgtcacattttaataattagtttatactctgaagcttttgttctatgtatttaaggatttttgaagtttttaggttctctgcaatttgaccttaatttggtgattcatgtagactagtgatcaatagtgtaccataacaggctgacttttatgtagtagaagtaagctttcaaaattttatgacactggaggtgcttaattgattctatagggacaaatggatggatgattttagttgaaagcattccaagatgttgctttgttgtgggttttcaagtcatcatcagtctatgggactttataatgagcctttatggtcttctcatgtatatgtacagttagaaaagcgataaagctggaaacccttactttttgctggaggctagaagctagaagaaagaaggtcctggtctccagtacttattcaggaaataaattatgaacttaagagtgatctctcatagtgatctggttgtccctctctaagactcatctgtgctccaaacaagggcctgttcaagtttatcttttttccagacctacttattttgttcttgcctttcatgcccattgaaggtttttttaaagaattcaactacatggagactgaagagatgaatattttagagttcacttctggaagaatctacatatttttactttcctaagtatgggctttattatcacatacagtcatgcctagccatactgtatcatgagtctatattcattgaagttggttcaaaataaccttcttttttcaaaaaaaaaaagtaccggacctgtacaaataaagtggtcactcttcatgacatctcttgctcgtggtcctctgtaaataaactttccttcttttggccaactctgtcattctcattctagtgctacagtattatccattatttctgttcaatgtaactgaaattaatttttctatgacacctgttccatattatttcttttaaacacttaagataaatatgtgccatgccttttttgtgggttgctttggtactaaccttgaataggaaatatttagtgtgctaatgacttagcacgcttaccctttgaagagcacgtaaagtatattttgtggtataggagaacaaagtagataatatgtggtttagggttaatctccatggagaaggaggtggtggggtgcgggggtgggctcgggcgtagggtgtgggtgatcggtctgcaaattcctgtagaacatgatactgatgggcttcgtaaggcaaccatcatcatccatagtccatttcattcagtggatgtttctagacggttaacctgttttaccacagtcacacgtccatgtagaaagagaatcgagacaaaaatggatcttgagtaagccttggtgtcgcagaatagcacaggaatgttcccgcatattactttcctgttcagcaaagtaagatgcatgttaaatgtaaacaaatagataaattgttttggggaacttttaagcctttagaatcttgttcagtgacttcatcttctgaatataggtgattggttccagtgaggacagggacagaattccaggcattgacatagcccttcatgatggggaaacatggatgtttgctggtcatcaggtgcttgtgatggaaactcctggtcatacaaaaggtcaaatttataaaaatcacctgaaactaacagatctacctttttcctactcatgtgatatgctgattacctcattagaattgtatataatgcttttcccgctcatggtttaccataaacaaaaataatctattccatgctcctttttttttgtttatactttaggcgtggaagtttcttactaatgattgaatttacttgttcatttgacatggttattttctaaagatcagaattggaaatcactttctttgtaattatgaccctggtaacaatgttttcagttatactcattccttttcttatcttgttctactcttatcatgacttaataaacgtgcacaccctcctccgaattttataacttttcttaagtaatactttcttttgtgcagatatttaaccaaactattctggacatttcttgaaccattttacttaaatttttgaataaccaaaaacaagtagagaacaaggattaatatatactgattagagctgttatatctaggcatgtagcatacataataaatatgccatatattcttctaatccaaaccttactttcttgaatcttaaacaggtcatttaagttattactttctgggatgtggagcaatatttacaggggacattttgtttagcttatcgtgtggtaaactttttgaaggaaacccagaacaggtttttcactgaactcagaattttttgtttgcaatgaccgattctatcccaataatgacactcatctgctgaagatctgacttggttgtttgagtaaactaacctctgtttctgtgccctaaagtataatagacagacttaaatatggtgcatgcatataatattagaatcatgttatcattccaagaaatgaagttcatagtgtgcacaactttagttagtgagtagacctatgtgcattctacatgggccttacttttacacacaaaaaatgttaaaaggtgtcaacataaacgtgcaatatatatttatgcttgtgagttcgtataaatatgtctgtggatgtgcacagctgcttgcacaggtcttggtttggtgtttgttccactggttcatgcataggaattaaaatttggaaagctatctgtacttcctattgctccatccgaaattttatttcgggcacaatcatcagtggctcagatctgcttgtgggaaaactcaaagctcctgattctgacaacattcaaagttcaaactcatttgcaggttctgaaaaaaaggttgcaagagatctaattatttcaatatataacaaatttatcttcatttgcacaatgaggtgttatataaggataatcaacagtcattatataatggtatcttatatatagtttcagcagatttttctataataagaatctgtaaaatttctcatgctgcagatgttttcttcacttcaaaagattatgtcgttgccagatgagacaaacatatattgcggccatgaatatacactggtatgcaattctgtaggtctgtaagtagcacactatgttctgcttatccgaatatgttttggctttacttctgacagaacacatggtttacttaaatttgaacagagtaatctacagtttgccttgtccatagagcccaataatgaagcacttcaagaatatgcgacacatgtagctcacctccatagtaagaagctgccaacggtaactactagaatctcctaaagttattgatttgagtgtgattaaagatacatgatttgcactgtttctgtgaatccacatggtgatctcgtaatttgattgagtaaaaggcatttaataaagtacaatttcaaagtgaaaactagctattcttctgatttactcagattctgaccaagaattttctgtatatatcttagattccaactacactaaagaaggaaaagctttgtaatccatttctgcgcacctccagtccagaaatccgacagaacttgaaaatcccatctactgcaagtgatgcgcaagccttgggtgtcatccaccaagcaaaggataacttttaaggcagtgctcatgcttgacttaacacaggtttgtattatttcaagagaaacaaatatatgtatattgcctttttgtaatatgcccaatcaattcctttagtgccgatagttcacattgtcgggcacctggtgaaatgcccctccagttccaatctcatccagagttatattcgttttgcacactgccaatgtgctacactgcaataaagaagtatcaggatttatgtatggcatcattcttgttataacatcaccttttgcaacacccacttgtgctatcaaggattgtcggtggaaaaaaggacaaggatcatatttatattcagatcatgtcaatataatcactatggtgtttcttgctatcagtttttcctggcaaaggaaaattttgagatgcctgaagagcaaatgaagctatgatagaacattctaaagttatatttagggatttttgcagtaaaaatagactctattttcttcatttgcagaagagacagatttatttattatttatatattatcgatttatttatttttgcagaaacagtgagcagtaggtgaatgcacacattttatttagttggtgtacaagtgtattggatgcagacgtgacagaagttgaggcacatttaaaaatgctcttgcaaataatagcaagagcaaaggtattacaatttcacaaattttttaaaaatggaagcaaattctggcttttatgcaaatttgacaattaagttgatttttgtgcataatttatttatattaataactcagatatattctctctctctctctctctctctctctctctctctctggttgttgttgttgtggtggtggtctgggggccttagcgtggagggatgggacgggtggcactcatagataaactcttagttccatgaggagctggtcatttgttgatcgttcaataattctatactattgaaattcccgtcagcttgaataaagttgttgtttgaactctgtggagattcctttgagttcatgtgtttgccgttgactccatgtggcagaggcttataaagacatttttgctgaggcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccctgatttgctaggaatggttctaatctgaacttgatttcccagctgagctcagtataagcatactgaaccctatgcagccatttaacgttaaccaatagttctaaatgttgggtctatgcagaaaagttaaatccacctgcacataatcagttggattggattcagtctagcctatcaagtgaatagtccagatcttggtcaggatgaaccccaagcacatttgatcaacttggacaggaaaaaggcaataaggaaaccccccaccacacacacgcacaacccaaaaaaaaaacacaccatctaaatctaaagcaacaatcttccatcatcttctctccaacacaacatccagaattttccttataggaatccacactgtgccatacacctgcaatcctttctttttattatattgtattgtgccaaatacatgagaactagtgtgtagttgtaacatttaaatatcaaacataagatctcttcttggttaataaaggtgtgcaaccaaaacttatcccaaatgaagtttttgttatataacagcattactgaagttatgattttgtagttcaatttttattttacagacacaagattggacaagtaggcccttgcttgatgacaaaagtggaaaaataaaagaaattttgtttgaattcaaaaatttgtgtacatttgaagtgtaccttacagtgatacaagtgtttgacttttatggtgtcatatagatagcatttacagatgaaactaatgcatgcatgtgtacatgatctccactttcatttctgatagttggaaaatcatggtcattgccgaaacttgaacttattaaaaaaggagagcacagttaaaattattatctaaactacatatttctatccgtaccccttttgttgtaacttccatgtcccatcacgaagcacagataaaggctctttaatcttttttcactctatatttatagaatgaatttagcttgattctttttcagatggaaatgattatatacaattaacagcaggcctacaattcatcttcctgtcaagcttgtcttgcttgctgttgtgctggccaatgaagttcgcgagaagctgggctttggcgtaatagccagtccactattttctcctgcaatcatttccactctctcatgctcgaggactttcaattgttctgaagctaaaaggctgattggatactcaccaattatatccttggaggtgagtatgctttctgattcttcttctactgcaaaatattcatgttttgattctttatttctttggcttggtgttcactaatgtactctcaaatcatgttattagtgcccacttaaggaagcaagtgggtgggttatgtttacaacatttctttcttaaattcaaacttctttttttgttttgtttactttttagaactttttaaaggacatgcattaaaatgcctagttcttttctaactcacatgtccttagaaatatcaccttttgacagaagtgtttaaataatttgtggtcattgattttgtgttagtaacataaattttgaccctctcattggatgaaaaatttatactttttatatttgattggtgtatttacaggatggtgttacgataactctggaatcattctcacaattagctaaaggctcggcatattcaaagaagcaagattttaccaccccttcaaaagcagataaactgttaggaagtggagtaggtgggaccaatagcttcatctaaacattcttctttttttctacctacagggggtttttggtttactccatgactaatttaaaataagaaaataacgtaaaggatctaacaattaccagcaccatttttttggttatgctgtaggtttgggacattatgatgtgttcctttcatatgatggctgttgatatctgttttcagttctttaattaacttcgaattttgtcgtattgcagttgctgatatattgctgtggcgagatgaacggaagacttttacatatatcctttcatcttatctgctgttttactggttcctcctgtctggaagaacttttatctcatcaactgccaaaatcctattgctggttgcagtcattctctttgtccatggctttctaccttcatccatgtaggcatcactgttaactaaattctgtatggtgctttagaaataacttctagtaatagtggaactattttgctcattcttgccttaaatgctagcatgttcagtatttccagttaccattacatgtatttataagattaaatgcaatgagttatttgtcattgtgttatactttgttcggaaagtccaagccataagtaaaataacagagagcgctcttacatttgccaatatgcctaaagcaaccagaggttgcttagttcttctaaaggcatcttattggtcatttattttctgtttcatttgatatatggaattgcagatttttgtgatggtgatgagatattgtagaattcaatcactttggtggtgtggcaaaccaacagatgtttgtctttattcagacagcaaaaggaatcaacagacatttgtcaccattcagatttcagacagcacccaccaacagcaccacctgcaagtcagaaaacatcaatttagttgtacatagctctgaacaagccaacctgcatgaattcatgaaaacccacatgcctatttgatccactacacagtcctcccaaatcaatgagatactagataaaccccttttatctccaccatcctttttgacttcatcaaatatgacctccacccttttgtgctttttcaagatgctcttgttcttcctgtctccaagtggaccacccaattacaaaaggataaaagagctatttcctatgttcatcagatctaaccagccatgcagacaatctctagttaggaggctctacaagaaatttatgaagaagtcttaaatgtatcctgtttctagcatcttctcttcaccacagtaagattgacaatggggatttgatcacacataagggcctgtggtcttaacctttcagactgttgggtagatctgaaaccaatgcattgtctcaccccattgccaaatggatggcacttcctcctctaacagcagtccacacttcatttttttgggtgtgcttgcatttacatagaacgtgagtgcatttatttagtcctaactcctaacaactaaacattgatcatcataacttgtgtaggttattcttatagttactataaatgcaatctttattttatagctgagccgatcaatctttagtatttcttatagcccataaatatggtacattcctgtatataatgtaggcatcctgattacatttttttctacaggtttggtttcaatctgcagaagatgccttcatcttactttcaagtctcagaatcaactgtgagacaatcatttatcaccatggcagctccatggaacaaagtaatttctctgttgaagttactagcccaaggcgatgactggaacattttcttcaaggttagaggaatgaccagaatttcttggtgtgtacttgtgattactttcttattcttgctagcttgcattttagaacttcaccttgtacattagagcatgaattgtgcttttcctttaaaaccatgctttgtttatgtatcagaatccctccgctgggatgatccagaggtaggccaacagaattgtgcagaatctgtttggactgaccatttggtggtttaaatgctgcaaaaccacaaatcaaatcaaacctttcttatattgttattgacaaatttttaatatggatcagtcaattgaattggcaagaaacctcacgggagattattgttggtttttaggattttgaatgttatagatgtgcggaatctcaagttatatagctttgtatagcttaacatgtgtcttgcagcacgcatgtgagatagaggggtgagacctgtatcattttttgtatgatcctctagttgctacctatatttccagaatacattatcatcataacttaatgtactatagatgtattattttatgtttatttcaaaatttatgtttacatgtcctccaacctacactatcaccatcatcatatcctcctactccaacattcattacatttatcctccctcttccttgtcctcaccaggccctccacgccctgcctattttaggtgctttcatttgttggaggtgaatagcggaggaagtggagggttgcaaaaggagttggctgggtaggctctatagtgttggtgagatgagttgctgggagccatttgcttgcaggttgccagccatggtgaggcaaagcagctagctgaaatgattcatgttttgttatctgaaggagagaagtggcatgattagatgagggaagaggaagagggaagtgggaacggggaatgtacacacttcagtttgctagatctttcttggtgcaatggatgttggaacgctaagtttagcccctctatcctagtaacagtatattagcccatctttcttttcgtccatcatgcgcggtcatggatggattgagattgatgtccacacactcatttgccacaattttggaatcgagagcgtgcttagactctgaacagagccaaacatccgacttctacaccttcacatggagccattgccatttttagggttctcaaaatgctgttctgctagaatttatattaccaccacattaacttgtacgagtgttgttttagtacttcattaagatatgatttttccatgtaaaaaaatattaggctaatttcctgtgcaaggagacaatgaatgtggtgaatgtctaggtcaagattttaagttttgaccaaaattgatctgtttcagctgaatttcagccaggaccgaaccaaaactgtctttcactttcaaattttgatcagtttcagccaaaactggctggttttgtccaactttggtgatttctgacagttgcagccgaaactgtcagagactaacaataaatgtcacttttatattttattttggcaattagaataatgttggggttatctctttgctatgtatgtagataagccatatttcaattaagagaaaggatagataataaatatgaactttgacaagccaaggactcctagaagattcttaccatggcactttataaagacaattgtgatttgtgaagaactaattaagagacatttcacagcaataatatcttttttttatatataaaataaacatgatgctctaaaaatggcattcatttgatcaaatagccacttgatctaaaaaaatatttaagatgcctattctaataaaaaattgaagggatatgaatgcaataggcattaaaaagcttcatagtttcttaatataatgactttttgaattaattgaatgtcaataagtgaaaaatgtatacgtctgtatgatgcttaaattcaattaattatatgcaatattagtttcggtctataatttgacagaactatgcaaacagggaacctatataacacaaaatgctgtaaactgttgcataacttttcttgttttcttttcttctccttcgattttttttgaattttttatgactttagatcgaaaatctgaaacttggagcaaaacttacaaaatcactgaaactgccaaaatggaaactttatggagccagctgaaactgaaatcaagaccaagttttcaaaccttggttaaagtgtacttgaatgtatttgttagcattgatgttatcatttgttaattcataactaaattgttgcaggcggctggttttttatgtgtgatcaagttgcttttgcctttttcactatcggcattgattggtgttggtaaggattcaaattgaagctaccactaatttccatatgcaattactatttcaacatggtcagttttttcaccccttttaccatcaacacaggtttgacatgcttgtttagcctcttcataatatatgaacaatgcgaagaggaggttgacaaactagtatcaactgtatctgctggaatgaggaagttgaaggtaacgatggttgctaatctacctagtttcttgatgatgtatttgcaagagttaaaaaattgaggacgactgcttagggcctccaatatagcaccacgaaagtcattcacttgctgttggatatcaattgatcagctctggtaagtgttcttcatgggaagagggtactcgtagagttattaatttaagcatgttaatttaagcatatttatttgagcatattaatctaagcatattacaggaggtacctgataatcagctattagttcatcatgcatgagttatttgtcattgtacacttgattcacaataccaatgaatttcaacattaccagcttttatacattcttcgtcaagcttagggttgctgggctcatgtccttgagagtataactttttttgagaactaggataagaaaaagtggggttgaaatccggtgatgggactttaacccagtttgctgctatcaacaactagtgactttaccagctcagcctgtcagtgtcgtcattgttcagattatagttattttaagtgtcaatgttgtctatatccctatgctagtcgcaagcttcataggtcagtgttcttaattgtacagatggcttgcatttttgtttgtttttctagcatgcttatctagtgataatggtaaataaaaaaaaggtgaatatttgttacagtagatttaaggggagagcatctataaaggtaacagggcttgaccatgctctgcaggagctggaagaatagtaatatggaaacatgtggcaaccttagaaaatgaaattgactaactgttcaggctgatgcctgtagcgtgtcctatttgaggaattaactcatggcctttctatcctaccagaaaaggtgactgcctatgcaatatatgtgcatttgctttttcacttatataaattattttttgggactagtctaatgatgccatattaattgttttattgttatctagattcagattggaaggaaaagcagaaaaatatcttactttttatttttttttacctagtttatgtcaccttagtgcctgttattgatggcagaaagaataacgtctatactgtaggagaatgtggaaatgcttttagcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggagttgcttgtgagattttattaggtcctccaaatggagcaacctcgtatttgaatagatttttctttcttttggcttccttatgagaaatgaaacaacccacttcatgatcttgcaaagctttgcatggaatccaatgaatcgaagcaatgcatatctagcatggggaaaaaatctaactcctcttatacgacaataagcaccaataacatatactttgtatagtagaaagtatatgctctaacatacaaggaaaataatccttctatattacatgttagaaattatctccactttcctcttcacagatggaatgtaggagttacaccttatcataagcaacacagcccaagttcgcaaatcaaatccaatcacctgcaatgattatacgataaccaactctaccttaagataacctaatccataaccctgcaaaatatgtgtagcgcatgaactctgcgggactagaccgggggttcatcgaacccagccaaattctatccaaataaatcaggtggggccctggcctggcgagaaattattggatgcaccaggcgcaagtgaaccagggcaatgcacggtggagggcgtgcaatcgggaattgctgcaaatacaaggggtagcgtggcgtgttatccaccgtgggatttgacgcggtccaatagcaactggtgcatgcaacatgaggcctggcggtgccttgacaaaagcccgccatagaaggcagcaaacagtttcacggtatggtcgacgcacacagaaacagcgtatataagaaacaggacacgtcttcctaccccgtgccctaggcagcgacatctcttttttctcttctactatcctctcggcagctgcccctccgccccgttcttcttctcaccgccctagggtttcttacccgttcctacgccccctctcttgccccctttggatcctcgaatcggcctcccgcatcaaaatctctggaagatctcctcctttccggggttctccaatcccgattgcatccctccaacgccgtttcttgcggatttcttggccagatctgttatagggcttttgcaccgccgatgccttcaaataaatcggttggagggtcgtcggaccaccaccggcggatgctttccaaggaagggaacgacgatgaccccccgtcgagcgttctctgggtggggaacctctcgccggacaccatcgatctcgatgtcatgacggccttttccaagttcggcgcattggactgcaacacgatgcatggggccaggagctactcgttcgtgttcttccggagcattgaggatgccaaggctgcgaaggatgccctccagggttccacgcttcacgggaataccgtcaggattgagtttgcccgaccggtttgtccctccccttcgtgtaatctgatatgcattttgcttagattgatggaagaatgcatctttcttctcctctttcttctcctctgctgtgttgcttatgtgttaatttctgtgggcagattgtggggatggattccaaaaatgcattctgggttaggttttacttgtttccgattaggacacgtttcttcattgtttgtctttcttggttttgtatctggttattagcgtggcaaaaaaaggaaaaagaaaaacggatagaagatttgataaacgagacaatgtggtgatcttttctaagtaccgagacagaattttaggaaccatatatctcatctgaaagaatcttattaaattaaaatttttgtggatgattccttttttttttggattggatttttttttccttttgattaggttgttctgggcctgatttttttttaactcttctgattagtatttggttattaacaaggaaggttgatacagtatagcaacttctgtactatcttatcaaacagtttctttaataaaatgccatcactgtgtttttttttggtcagttaaatgatctttgtggctagttagacattgactgatgtagtcatttgagccaaatttgtaaaggggatgcatcaaacactgggagtagttagaattggcactttgattctgtcaagtgcatgatatttgcagtcctcgtcacgtaggaattatgcagtcttgttaggtttggaccactaggaacagacacacacatatacacatgcaaaggtggatgacattaaaatgatagtgtcttgtaaagcatattcatgttttcatggattataccctcgtacatgatgcggatccctgtgataaaggatattacatggcaattaacaaatgtttcaatcatgaacagaggtgccttttgcatttgcaaaagataaaatcatcgcaccgaagcaagcaagtttaggagctggtgtttttgattcaccttttttttggttcattttgtttgctcactgtctagttatttcagttttaacagatgacgtggaatttaaatacctcttaacattgctggacagtttttatggaatatttgaatgcaggaaccataagaatttggttttgcttttgtgaattctccaaaaatatattccttatagtaggctagtaaagaacttggaaagttgctaattgaaatgtggctaactctacaaacatcgacaattttgtttgtgtgcagacttctatcaggttgtatagtttacattactaaaggtggatgaggtggtgcaagtttttcgtgccaattaagatttcaaattcatcatattttgtagattgatgtaaaggagggagaaatcattcaggataaatgtttttgctttgtactttcaaaatgattgcaaaaaatttacattcttacaaggcaaattgaagatagcctatttacttcaaagagtaaagtctagtcaatttgtacatggatgatagatgtagggggttgagagcagttgtgcttgcaaagaaacagatggggcgatgggctaggtgtgcaccagccaatgtcccatgaatatgtccacctaggtgagcatcagcttgaccaatacatggggcagttggccattggtagtaagctaaattgcttccatcaataacaccaattgagatagagggaatataggatgttttgtatctcgtgcatgttcaataaatgtggggtttgaccactctctgagtcctatgtaaattcttttaactgttgaattctgatccattacttgtaaggtaatggtattgttttggatttctagttagttctatttagttcctaatgctgagcaccacatcatttgaaacacatgtagttttattattgttttagttttcccctaaattgaccatatgttggccaaatgacctatgatagactgatggtttgttatgagtcacaattgagatgcctctgaattagtcaaattgttttaagtgaatgaaatcattgttaactatttggactagggttaaggtggttaactctctttaagttgttaaaaaacaaattcctctctcaacttgacctttctagagtaattcatgcttgcggaatgaagctcttttattgacaactcaaactgctgttagcaatttgaatccccttcacctttatgcacggataacttctacaatgtggaactgttttatttaccatatagttagcaatgttattctcatgcctaatgtagtcatcgagaacatcttattttgaggtaattgttttcttcttggatggtaagggtaggccagtgcatgaggctttcgccattgtggggtctggacgtgcacaaccttatccccgcatgcggagaggctgtttacgtattttgaacttgtgagttgtgacgtccgagtcacaatagagtaactttaccattgtgccaaggttcactgtcttattggatggtagtggacaataaagtagcatatgtttcatcttagtgtttgctgtgccttcagattttaattatggtttctaatttgaaagaaacttggttgtaaggctcaggcatacccataaaggttgagaggatcaaatggttctaagttgtttgttgtttaccattctatttatctttcttagctaagttgctataagatgaatatttttttatttttcatttcaaaccttatcttgcaaatggaaccacatttcaagcatcacaggctgctcttggacataccagcaagaatagagagcttgagaggaattaattcaaaggaataattgctgctaagcaatctgggggaggggggggggcaaactcggattcgcttgatgacaatagttcaaggtgattgaaagtagttatcctgcgaagccaaaaaggataaggttgtaattgctgagttatggtatgctaagaacgtgcaagatattgtgagcatcgtgattggcggtggcaagcaatatactattacaatgttgttgagattcgacagattgagcaagaaagattgtttgttcatttagttgggtgtttaattgcatgtagcaaaagcaaaattgttcatttagttggatggttaattgtatgtagcaaaagcaaaattgttaatcatcaataagatgttcaaatgtgcaagtaacctgttggctaattcctatttgtgtgctacagcacctaagtggccagatgtcctggagtgacaaatgcctaacctgtagcataggtagctttgcaagtacctgtcgaatttcttaggcaactaatttcgctgcttgagcttcatttaattattattaaattttgccttatatttgatgatgcaatgatatacatccttgaagtcaaaccccatacataaatatatatgtcatacgcgcgtgcatatatatacatatatgtgtatacatacatccacacatgcacacacacacacacatgtatgtatacatacatatgtatatatgtatatgtgtgtgtgtgtgtgggggggggggggggagggaagatatgtatgtgttcggcattttaagaatatgtgtgtgtgtgtgtgtgtgggaaggaagatatgtatgtgttcggcattttaagaatatataagaattaataaaattcatacaaatagataatgacaagtgaaaatcaataactaatagataaaaattcaggaaaaatagaaaactgtattataattttacacttatatgagcctactttgatattctaggatgttaaactggaaatgctgatattttcccaaataatgcttaaacttcagatatgccataactaggtttacactttctgttcagcaaacaagatgtataatatttaatctattaatgttcaaaaagaaacacaaacttgttcttgagggagcaacttatcaaaaagccatttttatcacagcttatatgcaccatagccacatatgtgagccatgggctgtttagttgcttgttagttcattgtaggcctacccaagtgtgatgtggtcaccaagctgcaggtgcatagatggcttcccagacactgcactttaacacacacatataatcggtgacatatatgattgttgttccaacttaaacgttaatgattctatatcttttttggtcatccaacttaccagcagttggttcttgggtctaatgtttttatgtgaagtgagaaacgtttatagctgactctaaaaaatataaattatgctacaaacacacaataacatataggttatgtatgaacctgaaatgggatatattacgctcactaacataaagttgtacatagataaacacatataatagcgggtggctaatgaaattatttttttaatgttgccagcttgcctaggtatgtgcctagaaggctagaactttcttagcacctgcacctgatgggttaaattgtaattgcctaggcaatctatggcccttctgtagggtaggcagttgtccaagccccaaggaggcatctcctaatcagaataatgagaatagtgacataacatgtataattcattttatggtttcatttgacaacttcaactacgtgctgtgttttggtgatcctatcagagcatgatgctgcagctagtgtttagtgtcatgccttttttctcgtgatgttcataaaaaataacaaatcatatctcaaaggaataaaagtttttgatgtttctgtaaataacaagcctgcatttttctccattcaaaaaaggaaaaaaatgaagctgcgtgatatagtttaaatttgaaaatcgtaaaaaatcctcatgtattattaaaggttgcgttgcggaggttgggtatttttccttgtgcatgccactcaatgtgtgcacaacatggcactgaatggccatgtggcttgctcaacttgtgccagtatacgtagcgtaagagatgtaaaatccctggttttaaatccactttacagtatctatctattgtcacaatttgctgtttgatccttttacatacattatgtgagtttttctatttcgatcataattttggaaaccattttgctgtcagcaacaagtcacagggatttcacatcctgtgggagtggatgattgctgattttgtgggatgtgtatgagatttatcgatctcagtagcaatatacccaattctgagcagattaaatactttgtttgcctgcttatcaccagttaccttttacacctggtgtaatggtattcagttaaactatataatctttaccactccatcctgcatggtaaaagtgctgttcagaacaatatgaatataaacctgtatattattgtttaaaaaccaatcatttgtgaaactaaaaaaaggtagcatattgagtcaaattgcatattatattgacatcacattgttataggcctgatatgtttctttgccaactcgctgacattatatttggatgatcgttggcatattttggatcatactgagacatcacatgctacttggttcacgatttgcacaagatatgatatgtaaagccaaaatgcatatgagttttaataaggccatgtttactgttgaaaatgtggcaaaaaccctgtttagtttttcgcataattgttttggacatcagagtgctgcattagatatcatgttcttggtttatcattaattctggagaatattagtttcaatgctgagtcactaatcactttatccttatttatgttagtatttggaatgctgttctgctaccttaacatgtatgcatgtctacatatttatgtatacatttatatatgtggacacacttaacatccttgtctatattgatgtttgggtatggtagcttgaaagaatcaagagtgttgcaactttttgtgtttgatgaggtcaatgcaattcagttacattatgcatttagttctgttgagttttgtaaatactatacctgctgcatgttcataagcctaaagtactaagtacatagaaaagaaaaagtgagagtagtcatgtgcagcctaagcttattgaccttcacttgtaattgtgcttttaaaaggtcacgaatcaactaaatatgaattgttgcaaaagaaagatcttcatttttggtgttatgtttaattatatttgattgctggtaatcaatttttccatcctttctttgttataatctgctacaagttaaaacttcaagtctgatttctaattacaggcagtctgatttatatgctttagtaaatcaaatttgaacatagaaataattacaggcagattaagtttgggatttcatgcattcttcgatgctttcatccttttcatgcctttcctaattaatctttttacactagaaatacgtacctgaccccatatagatgagaccggacccattgattatggcatcttgttttcctcttaagatcaagttaatgtgtatataatgatataatgatatgttaaagaacaaaagggtcatggttgaatattttcttctaggtctcacagtcatttgcagtgaaaaatgacatacagaagggtgctgaaaattttcttttaatttttggtttcaggcaaaggcggttaagcatttatggattggaggaatcagttcatctgtcacaaaggaacaacttgaggacgaacttttgaagtttgggaagattgaagagtacaaattcctcagggatcgaaatgcggcacttattgactattacaagacagaagatgccattgctgctcagaaaaatatgaatggaaagcgtttaggtggtgaacaattatgtgtagattttcagagatcccagcctcctagaaaggtgtgtggttagtcatcacactggtttttccatgtttaatattgctggcatgcctgttatccgatatatatatataaattaaagttttagtgacttttttttgtgtgcattctattgttgccctgataccattatcatcatgactataggattggcctgactatcgagactcaaggaatggacacttaggcaatcggagtttggggctgcaggaacgatcgctgccacctgatgcaagaagtttccatgattcttcctatcatgggcttaagaggcatatggtatatatcttgaactagaaagttaaactcctgcaggatatttcatgacatgttttgatctgcatgttttaccctgttattgtcaattgaacatcggattagaagtttactaatttatggactgtttcgtgttttgtatttgttgaaaatttctcagcctcatggaggacgaagagataaccatcctagtaatgttctctggattggctatccaccttcagtacagatggatgagcagaagcttcataatgccatgattctgtttggtgagattgaaagaatcaagtgctttccctcaaggaactactcttttgttgaattcagaagcattgatgaagctaggcgtgccaaggaaggtctccaagggcgcctttttaatgacccacgaatacagatactgttttcaaacagtgagcttgcgcctggtaaggataatccaccaccatttccagggtttagagggcctagaccagagatgttctttaatgaaggacctattggacctttggaattgtatggtcctagtcgtccaatggccccaaatagtttttcgggatccttgcttcataacaacatgcctggatccagtattttaatgaggccatttggaccacaaggatttgatcctcatcatggaggtccagagttccatgattttggtggcactgctatgcctcctacttggggacgacgatctccgtctgcaccgggtattcttccttcgccaccagccttgcgccctcctttccgacccatgcctggtttacgggatgaattcgacattagagatgtgaagaggtccaggacggacggttcttcgactgatagtgctttcttgcatgcaaggagggtggatggcgagggtattggagatccctttgggttttctcatcccgacagaggtgcattcagtcaaagtcgtctcagtccagttcttcatggccatggtgaacttcatccttctcctgatagtgaccattgttggcgtggtattattgccaaaggtggaactcccgtttgccatgctcggtgcgtggcagtaggaaagggcgttgactctcctttgtaagttttgactctccccaacccatgcatgattaactttataaacataattggttatacattatgataattgttataaaagtaatcgattatctattatgatgattgtcatatgaacttctttggcaggcctgaagttgttaactgctcagccagaacgggattggatatgcttacaaagcactatgctgatgctattggctttgacattgtcttctttttgcctgacagtgaagaggattttgcttcttacactgaatttctccgttacctgggcttaaaaagtcgtgctggggttgcaaagcttgatgatgggactactctatttttggtgcctccgtcagattttttgaccaaggtattgaatatttctggtcctgagcgtctatatggtgttgttctgaaattgccacagcaatcaactaatgctgtggtaccacaactggcaattcctccgccatcccattacattgatcagcaagaggcatctagttcactgaagggttatcagtttgttccacaaaatgaagagcaagcttcaaaaatggattataatcggtcattgtatgaggagtcaatgcatcgtgcaggtgttgggaaatcacttctgacccatgctgatgaaccacgtgccctgcaaccagcttccctggattatgctggtaattctgctgctgcttcccaggtggaggtttccttgactcctgaactaatagctactttagcttctttgattcccagcaacaatccatcatcagctgctgcgactgcgcaaatgccagtctccacgggcagggcagctttgtcttctgcttctgtgatacatgatgcttcaacgccttctcaagggtggagacaggaacaagcggcagcttctagtgcttccttagagcaaccaagccatcttccacagcatttaggtcaacaatttagtagtcaggcaccactcaactctcattttccggcgtatcctaacattccaagtggacaagatccttctacacaacctattgttggtagtacacaaattcagaaccctgctctaaacatgccagaggctccatttattccgactagaccttcaaataattatacaatgccaccacaaggtggccaatttgctggcacccagagcaatcaacagtatcagttcgattcttctttgacttctcacagcaactatggcatgttacagacaacaaatgcggctggtgtgttcaaccaaccagttcagcagcagttaagacccacttcatctgctcatgatcacactggaaatctgccccagccccaaagtgccattccgcctactcaagggcaacacccacaacctgttctgtctggttcaggtcagggtacatcagatggtgatgctgataagaaccaaaggtaccagtcaacccttcagtttgctgccagcttactcctgcaacttcaacaacagcagcaagcgagcgctcaagctgtgcaaggacctggaaatcaacattgaaaaatgttcttatgtgacaggtattcttttcacctcgatttcattgatttaataatatgttgaactttctttcttagtttagtggtattcctaaatgcgattacatgagtatctgttagatgcatgtagttaattatttgttcttccttttaattgtgcttgcagaaatactattatgacattaatataacaggaacatgtttttttaacaagtttcactgataaatcctaaatacttctgatgattgacatattatattgatgatagaaatcttaaagctcttctgtcttttattgagtatttataataactttcatagtcttgaagtacaggctattgttggttttctatgagcatgtttcttcttcccccctttttcttgtctaatgctgaaaagcagtagaaatattatgattcataatgaagcaaagtaggtcaatctaagcgtttgtcagatttatgagatctatgattatttcactgtcatcttcaattgtttttaaattataactttgtgattattcagtatttggagcaaatttctattcttgattcatttcatttggttgattttggagattagaggaaattatggtctggatgtatccgattgcactgttatcagcattctgttggagaatgagtcacatgccacctgtaataaaaccaacctaatagtagattatgtaatgccttttggttgtttttgcaatagtaggttatataacatttttctgttgcattttatggtattaagtttggggaaaaaggaatagctatcatctttatagtgggaagctagaagttccatcagatggtttgtgggtaaagcgggcataaagttgatgataatttgatatgatgctggaatttatgaaaccataaagtttacaaaagcataaaatgtttgtagtcattaaatgtttcattacatcatcatcatcatcatcatcatcattatcattcatcattataggatttgagaagaaaaacattgttgtacaaaacaaaaagttcataggaaaaaataagattgtaacacttgagttagttttttagtgctctagaatttgtccaagaattaatgagctgacaaatatctgtgaggtgaaatgacactgtcaaactcttgaaagctatatcataaaacttctaaattgattagcaatgtaaaatttgggatgttggtttctggcgtaattaattacaatatgcaacttgattttatcttggattagttatatctgccttccgaagtttggtctttggatattgtttctttcgagttatggtgatgatgattattgaagtgcttagtgcactcgggacaggttgtatctttcgagcgaaaggagggatttaccttccttcgcatgaatccaccattggatcccaagatggtagcttcctgatctgtgcaggatatctgtgcatgactgcgatccaatggtcgatgtcatgaaagaagatcaatcattctttcgtgtggaatatataacctgaacccagtacacggtgaaattggtggatattgagtctttttacgttaagaaataaagacatttgtaggtgcgaatcaatcattgttgaaatgctgagtcctataaagcatgcttacttcacaggactaactaaaatgtatttgtggcaattgagatagaattttgactaaatactcaataaaaataatttacatgataatttcctcatattcttatccccgacaatgaggggcgcacaagattcctcattgtgaatttctcagccatattacatctggagtcatctttacaagagaggaattaaagatgaaaaagcacggtcaaatatttaaactggcctttgtccttggataagtgagaaacctaggtaagaacttcgtttttcctttgtctccttaagtgatttagattttttctctctattttgaaatgttgcaatgttctatttttgttttttatatgtataaatgtaagacaacgaagttcaaaatggaggtgttgctgcaaaaaaaatttgaagaactgtctttcatgctgatccttttgcttcgttatcattatttttcttgacgtgcttaaaccggtcgcctcagtgtcaaatcttaatagagaaatcaaccttgtcaatgagtgcgcccgtataacttttatatccttttcttcaagttgttaaggctgttcagaatgcctctttttttggttgaaccgtaccaaatcagaaatcaatcttgaaccataggcttttaaattggaatgaagtgttagtttgcggctggtttgaggaactcctgccgtccaaagaattaggaacgtgttagaagcaagaggctgggttccctttggaaccctaactcaaagggaggagtgttttgggggcgtgcgattttatccccctgctgttatctccgatggacttgaggaaccaaggaaactagaggcaatcggactagggactttgcttttgcgattttagttcccgctctaatctccgatggatacgaggaatcccatcaaatagaggaaaccagaggtaattagattaggaactctaccctttcaacttgctgtcatcctcgtttcctctatctgatacttttatagtatggatattctgccacgctaacaggagcaatgtagaatcaacatgaagcatggaggtccgcatgcttgggtaacatctctctgggcgaagctttattgatcagagaggctatttacaaacacgtttgcgaaagttatgcgcttgtcatgaggagagccctatgagtcaaccgaccgtttttttgtctaaatttgttttggatcatacagataagcagttggaccactttaaattttgttattatttcttcaaaaggcatcttagtctataatggatttgttggtctctaaaaggtatatcagctcagaaaggattccgatatttgacatgaataatgagtttagttataaaatattattttgaaacataaaatatttaagatatctttatttggctagggcaacgcatggaacacatgaccttaagctaatcataatgtttctggtgaattccctcttttcgaaggatcaaacaaatatttaagatttagcaaatccatgtttccctgtttaaagtgggaattatatttaaaatgtataaaaagctgctcccctaaaaggtgttgaaacgttgttgaggcctggatgtaatagtactgcagatattaattttagaatctggagttggattttgatatgccatcttgttagattcactttatgcagcaatttgtttgggtataaagcttgcataaagattccaagcttatgcttgccaaatggtcaatggaaaccagtaaaacctaggaatggttgtgttgatatgatagccatatttaatccttggggaagctgagataaactagcccttgtcataaaagtttatacttattttttgcttttttatagataaatatccctagtttaaaagagaaccctagtttaaaagttattctaaaaatggtagccaaacaaaaattggaacaatttctagtgtaactattcccatcgtaggcataagttttgctatttttatctttttctcgatccaaatccagcctaatagttaagtcaaggcaccccaatgtgcttgtaccgaaggtttctttttttgggggaaagaagtctgtggtatgtaaagttaaaagacgcctgtgatatggaagattgctagggcataattattgggggattctatggtcctctcgtctttgtgcatctgggacctcccagacaaatgctttttttttagttttctaacttatgattatgtactttctgtagaaactcatatgtactatatagtggtaaatttctagattgttaaattttttctgcctggtgctacaacaatggtgccttaaaagattgtattgcaaaagtggttctcataaaatggttatgtgctagtgggatggtaagagggcatagtactacatggacctatgtagggtaattgtgaagctggaattacactaaataatagtggtaaagttggtttgtactggttagacggaaaaaaggttgatttagtccacactgtttaggcagttggaaatgaggtcattggcaacctttgtctgttgtgtataaggccaacgtcatattctagagctggttagtatcttaagtaaaagttcttgaccagtaaggccggaagagtggtaaattttctttaagaggcttcaaattgttgtttgaacttgagttaggagaggcaggcaagaggaggaaagctataatcagttgtgaaataggacaggaatgtagtcttgaaaggcaaggagagatactcacaaaagatgaacttaatgaattttgattatcatcactatgggattgcatggcaagagatacttgagacctcgaggggaggttttaggagtacaggacttattgactagtcgaaagaggtaaagttcaaaggagttgggatggattttgaattgaattaatagttatgtgaataaaagaattatggtaatgggcaaaaccttaccagcttgaattttgcaatgatatgtatggattttgatagacaattagatatcaagttcggtgtgttcatatttatattataagtacaagaacatttgaaggaaagtgttaacattgtagcatcaaattatagaaacaattatatttgcaggtattctttttattcttttttttgtattgcccgacatcctatttcaggaacatgaggaaagtagggaagcgccaatgccttttatctcatagtgtgtttgacaagatatttgttttatgttgactttcatgttaccttccgtttagatagtaagaaagtactcgcatggttacttgtatctagctttgcttttggaattgatgaactataagatagtattgctatccattatttgagcctttaaggagattcgatatatgaagactggtgctacttccaataagcaatatttactgactatccgtgctttttggcattcttgtcacttcaaaggattaggatattaggatggaagttgtgacactcgtccatatcctaacgattcattgtagccggtggtgcctatgaaaagaagggaggtcttgttggctaaatcacccaagcaaagagttgtaggagttctctagtggaatactactctccattcttccatgctctctctttctcttgtgggcttctctcctctctcttcgagacttttagcttgagaggctggggtaatagattgacttagaggttgttgcgggtaggcaaatcaagtgctgcatggatgcttgatgagatttcaagcatgtgatagttgatattatagccaacttgtgggaaggagcatcatggcttctgaagctaccactatgcataaggtggctgagcaaaggaggctgtggggaagaagggcaaaggaggctgagacaagtttcgtgatcaggggagctgcatgaaggtaaaggttgccaagtcgagatggttgtgattgatacaagagattggtttgacgagttggagcaaggcttgaaggtgcttcatgatgactttgagaggcaggttaaggaactctataaggacatgctaagcatcgtgaactctgttgggaaagctcaatgtcaagagaatctcacattccaatcccaagttctagaggccttgacaaacctttaagctttgtttgaggagatgaagagcatgaaggagaccaaggctgattaggccatatgcaaaaaggtcatggctaatggggttgttgctgctcctattgcaagtttcactcaaaaggttgaagctcacaaagccaaggagtatgatggcaaaagggatgccaagaaaattgacaacttcgcatggcacatggagagacactttgaggcactctacatggaggatgaaaagttcaaggtgggaatggccactcgcttttctattgttcttgatgctgtgtggtggcataggaaacatttgagatggagagaggtgccagcttcattgacaccggggatgatctacaatgagaactaagaaacaattctacattgagaatgtcattgatgaagcatggaagaaaatgaaggagctgaagttgaaggggtcgatttgagactgtgctatcccccccccacccccccccaaaaaaaacatgctttgaattcttagtatgtgggctgcaactgagttataggtgtggtgtgaaggacatctcaattgcctctcatggttgtgaaaaccttagtggagttcgtaaggtcgagtttccagatgaaacaattccatgccaaatatgggggagcaaagtggtttgaaccatcttatagcaaggaggattgctcgaagagtaaactcccaaagggtggaggcaagccaccaaagggcaagaaggtggacaggggaaggagacccggaagcaactatttcttatgcgatgatctgcattgggctagggcttgtctagagagggtagcactcaatgccatgatcaaagagcatgaaagctaggaaagtgctcagatgagttttctttgactcgtcaatgtcttgaaggctaatctagtgcccaaagctatgggaggtaggaccttgatgtatgtcgagatcggcatcaatggcatgcccgcccatgtgatagcagacatgggtgcgacacaactttatcaagccagattagtccaagcagcttgggcttgagctgatcaaggagaaaggctgcttgaagatggtgaattctaaagccaagccttttgatggtgtaatttgtgggggtggagttgcaccttggtacttggagtggcaaagctgacttcatagtggtggtttttgttgacttcgatgtggtggtttgcatggagttcttgaggtagttcaatatggtgctcttgccttgatacaactttatactcattcttgaaggaggtaccaccatagtgccaacaatgaccaaacccaatttaggtaccaagcttctttttacgatgcaagcaaggatgtgaagaagtcatgtacttggctattttgaaggactatggtgggtggtaaggactttagagaatttcctaagaagattcgaggagtccttgaagggttcatagatgtcatgttgctcaagtagccaaagagcttccaccatggagggaggtgaatagagatgggcaatgggctgtgcctggtatggcacggtccaggcccacgggccgaaggtttaacgggtcgtgtctggcatggcttgtttaaacaaaatccttggcctggcacggccttaggcccaggggtggcaggccgtgccaggcatggcccgttggcctattaggcccgcgggcctttttttaataaaatttttaaaatataaaaataaaaaatattaagtaataaaaatatatgagagatagaagatataaaatgaaaaaattgcatcttcaatccattaatattcataatattaatgcatattaaaattaaaaaatttaaaaaagaaaaaattgaaaaaatcaatgaatgatgaatttcttcaaaaaattaaaagcaggagaactctattttttagaattattaaaaggatcaaatgatttagaaatatgatgagaatcttgttttgcacgaggactataattaggagcccataacggatataaacgggcatgttaagggggcgggctagcatgtgggcggggtcgtgtttgacccgacgtcgtgctagcccaagcccttatgggctgtgcctggcttgagctgcaaaacccccagtccagctcagcccccttatatgtgctgtgcctaacacgatccgttactgtagcaagtgggccgtgccaattcatgctgagtcgggccgtgtaatgggcggccctgtccggtgcccatgtctagaggtgaatcataagattgagttggaattgggagctacactacctgcaaaggtgccttatataatggccctgcctgagttagaggagcttaaaaggcagctcaagaagcttttggatgcaggatttattcagccttttgaagcccctcatgatgccttagtgctctttcagaagaagcacgatggaagctttcgtttgtgtgtcggctattgtgctcttaacaaggtggctatgaagaataagttcccaattcctctgattgcaaactctttgaccagcttggtaaagcatgatacttctccaaattgtatcttcagttcgtgtattggcaagtctaattacagaaggagatgaaggcaaaattacctacatgatgaggtatggggcatttgagttcatggtgatgccttttaggttgaccaacaccccagctacatttagcaccttaatgaacaagttattccacaactacctcgacgagtttgtagtggtgtatttggatggcatcatcatatacaactagatgttggaggagcatgtggagcacttacaggccattttcacaattttgcagtttccttctacatgcctttttgcctgggaagagattgaattcttgggtcatcgtgttgctagcagcatgatttgcatggacaaggaggccaatgctatctaggaatagcaggctcctaccaaaaggatagagttgtggtcattcttgaggcttgtgaactattatagaaggttcattatgggttatgcatgttgagctggacccttaatggagttgcttaagagggattgatcgttggattggtttcctaattgacaggaggcttccaaggatttgaaggcgatagtgatgtaggaaccagtgctatggctatctgatcataatttaccatttgaagtctatacagatgcctcagattttgttattgggggagttcttgtgcaagaaggccatgtggtggctttttgagtgctggaagctaaatgacatggagaggcggtactccattcatgataaggagaatgtagtggtagttcactgcttgagggtgtggagacactaccttttcaattaggattgacaacgttgctctcagctacctcgagacacaaaaaaagactcttcaaaacaagctcattggtgggacttcttggcagaatttgacatggctttggagtactagccggggcatatgaaccaaattgtcaatgccttgagctacaaggctaaacttgctacgatcagccagcttaaaggagatttgctcaacctaataaaggagggcatagagcacatgatacatcggccaatggattggtggacttacttgatgatgagagaaccaagcaattttgggtggaggacggcctgctacttacaaaagggtgctgcattttcattctaaggtgaggtaacttgcggaggaacataattaaagattataaagcaggtcggagactcaagacaacactataatagggcctcggtggaggcgacatacttttggccacaaatgtaggtgaaactcttatgtgaggatttgtcttgtttgccagcaaaaggtggagacacaagttctaatcgagttgctagaaccactattcattttcgagtgaccattggaaaatgtttgcatggacttcatcatcaccgtacctaaattcgaggggtatggatcgattattgtggtggttgatcggtcctccaaatacactattcatacctacccctaaagattgtacagtagaggagatggcttgattgttcttcaagcatgcatcgaagtcttagggattgccacaatagatcatcagagattgtgattcacgattcactggtatttttggacctagttcaaattgacgggcttagtgctgcacttctccacaagtttccaccccaaattatcattcaaaccaaaagggtcagcgagctactgaaggtatacttgatgtactttaagggggtgcttggttggggggagtgggaggtctggaatcggaatcggaatggatgactcccattccaactatttggctgggaggagtcccatttcgattccaattccggagtggaataggaatggctcaatctatgtagaactcaatccctactcttctttatggattcaaatttctattccaatttcgattctgatcacgaaccaagcgcttcgggggatttggccattctgatttcgattctgattccaattcattttgatatctattccgatttcgattttgattccggttgcgaaccaagcatcctctaaatgctaatcaataggattgggccaagctacttgcctcaattctcctacaatctacagaagatcgaggcgaccagttggagcccattggatttagctgtcggacaacaaacacatagacacccaatactttagttgccagctacatgagatcaagtctagcagctcttaaggtagcaaaatcttggcacgagcaagcagatgtagcatgttgttgtcttgacaaggctctcaagagaatgaaaagtgggcggataggaagaggaggttgctagagatgaaagtggaggactaagtgattgtaaaaatattgccctcacaatagaaggctacttgcaagttacacaatggccttatttgttgtaatgaatggccattccccattccgaggaaggtgggcaaggtggcctacaaggctataaggtggagttaccttccaagattaagattcactccttccatgtacattgaaaccctactatggagagctagatgaccttggtcgaggtgaatccaagagagcttcgtcgggcatcctaacatcctatgacaaggaggtggaatatatattggcggactgtgtggtgtgatggagcggtatacctcctagttgggaatatttggtgaaatggagaggactgctcgatagtgaaataagttgggaacctattgaagtgttgtggcaattttaggagctagtctaagaatttcataaaggcatgatgagggcatcaaggacttaagtggggaagaatgtaacagctcaagccttccatgcaacattgggtgcactgattctttattgagaggagctcgatgggattaagcttgcggaattctctagacctacaaatttagtagaatggcatgatatttttctaggctcttatggaaagagctagggggattttaatcgttgaaattgtgacatttgcatgtattcaaactactagttgtagttggtagtgcctatgaaaagaggggaggcctcattggccaaatcatccaaccaaagagttgtaagagttatcttctactgctaatccattcttctaatctctctctctctctctctctctctatatatatatatatatatatatatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctctctctctctctctctatatatatatatatatatatatatatatggagttttagcttgagaggctagggtatgagattgacttagaggcgattgcgggtaataggcttagaggctagggtaataggctaacttagaggaggttgtgggcaagcaaaacttctaagcgtttcacaagtgcttgtagaaattccaagcccatgacattagtgtcatctaaatttcttcttcttcatcttctttctttctctgtcttcgttttttgggggggggggggggcggattgttacattttatgccaatttgcaagtcaattcattataaatcattttaaaggtgtgaccttccatggagctatgtatttcacaactttgctaggattctaaatgaataagatttgaaatggagttggaatctaatcctatgatgagctagatgcttggtcctactagaattttaatctttgcaagtcattaatgcgccactgtagggacttcaaagctttgagaggatgtcttagtttaaaaaatggaaccttaaaaggatccaaaaaaattattagtgtggatgggcagatgaattgtgtcaaaggtttggaagatatcctaaggtatcctgcctatttgaaatctatgcaaatctttagataaaattgaatgatggataaacttttatcatgtaaataatgttcttttaaggtgcttactaccaattcttgtaatacttttgcttactaaaaacattaacagtaattaagaatgtattttctaatactaatcttggcaaattgggttcattactaccatcaggtttactactaaatagccaaattttcaaactagaatttgaactagcgaacccgtgaataacatagggcttgctgtaatagtcatacccagttgctagcaactagaggttttggcttcattcttggatggtgcatctcttgaagttaggatgtgagtaattatattgttggcaggttctctcccaaaacgttcatggttttctttcttttcatctaaatatttcgatatgtggtcatgttatgaagacacttggcatgagtgccaagagtgttgagtattttaagtgttggatacggcaatctccaaaaaattaggcacaaggaaacttggcatgggcgtcaaagagtactgagtgttgtgagtgttggatatgacatacctctgaaaacctagagtaatatatattgtatacatgcacacttgcactgtttccgttttgattgaaaaagcgcttaaaatgaaaggagttattgattctacgtaacaaacaaattaaaaagaacaaccatgagtttggatatattgagatactggaatactagttaaccattatacatttgttttaaaaaataatgatatttttcttaaataattatatattatgatgattttaattgaaaatatgattatacttttggatagacaagtcatgagggccaaggttgataagttgcatttctgatggaggccatttgtttgtagaatattttgataatttttatagtgtttcagtatttttattctgtaaaatagtctggtaggttctatttttgttcacaaattacttggttgatggttttttttttttttaatgaactcttggaattcttgatcctgaagagcattttccaggttctggctctagtttcagctctagttcacggttcttaggttggacatccttcaaaacgttataactcaaaactctgatgcaaggtgtacctgtcatgtttataatcaggataaaacattagggtcgtttagcgaagtaatgtaaggtgatgcattacttatgctggtcacagggcatgtcaatgtggtgatcgtgtcttggagaatagtgtgatcggttaggtgtgcacgaccttgtaatccaaagcattgtgcattagagccttcaccaatctagcaaattcttgacatctgatctgattaatatacggttacattttgaatcaaaagttcagaacatttttctgagatggtaaaggttgagggctcggtgggacttgatttaaacattatgcttcatgtggctggcgcaatgcgatacccggcagctttgcatttcaacgtgctgcgttgcccgtagcgggctttacgtttcggagattgcgtaccgccgtgcgaggtatttttacagcgtgatgggcaaccatgtcacttccgtagcatttgatgagaattttgacgctctttcgagttgtccttcgatttccaaattggtcgtggtgggacgtcgagtttgtcggctagcatgctgaatggtcccttatttcacttccgtagcatttgatgagaattttgacgcattgtccttcaatttccaaattggtggtggtgatgagaatgcccaactggtgacgggatgtaaaaaagtttagattgtcgactactgttcttagttaaataattgatttttagttttatctctggagtattggaacaaatttgaacgaccgaccatcagaagcgcaaaagggggttcatctttgatttccatctggttccacgggagtttggttgcgatttttgcgtctagggatttttttttgggtcgtagagttgcaaggctaattaaactatagtgatatcatcacaccaaaaagacactatagcattatcatagccatccatagtctggcaggtttgagaaatgttttaggacaacatatttaatattatcgttggaacgttgtatcgcttcctttattcttgtaattctaaaaggattgctcctcctaattgaaggagtatcaactacaaagcatcatggggcaaaatatattttggatttttgaataaatttacctcgttttgaagatccaccgtgcaatactgataatatttggaaccgttagagagtgtctctccggcacgttagagagtgtttgtgtcctggctgtttaacttgttaagaagacttctttctgcaggaattttcccgttggaaacctacgcttgaataaatgtcgtgttatcatcaaataaataaataaataaatggcttgtgtctatccagtcgctgtcaagtttacccatctattattgtgatgtcttcgtaggtgaagcttggagttattttcaccatattcctactggtggggacgtggaagcagtctattgtcgtggtttgctaatgtgttggaaccggaaatgggagtgcgatctaccttctaccgtgcagcccaaagtcgagagaggacgaatgcatcatgaacgccttgttgttttctttaccaaaaacaactgaattagtaagcagagagagatgtatcgtaaggacaaagggagcctatctgatgatgtggttttaggttaatatgaaccgaacatccgtctcagaatctgtatggtggtaattgcagttgccttaagtgctgttggtaatagtacttgttatattcattgcttttttaatatatatgtatatagtttttctaccgtctaaaatgaaaaatcgtatttctcaatggtgggatttgaattcaggtatttggtaataacttaccaatagattttaccacgaagtaatattcattgattacttatttatttaggtatttcaccgaggggagagtggagtcggtttcgaaaacgatgggctgttttatcttgcctggctggggcccgggcgggttagcgttggattgcttagagcatccattagttcatggagaaattctgtgtgtaccgcgtggtacggaatctgtgcactgtgtacggtgattggttcggactggacagcggtgtagaattttttttttttatttggttctgcgtataagtcaatcaccgcatgtgagtttgatgcataaagaatttctttagttcctgatcgaacctgtgactgttttctttgcacaagggtgcaccactgattgggcttggcccgtatttaatgagcccaacttgccgtgggatgggacttcggagctaacgacggtctggtctaacaacatcaacccaaacttagacttcgacgttgcttgaagaaagctacctgcccctagcctaataagttaatagttatttatctgcttcgtaagcaaataaatttgcaaaatttaatagatggtattgagattgttatggaggttatccatctttcgatccgacattctcctctttaggttataactgagcaatcactaatgactcattaagactatcttggagagtcaagaagcgaaagctgaatgatctcatgccatcgattcctatcaagactatcttggagagtcaagaagcgaaagctgaatgatctcatgccatcgattcctatccaaactttggcttaaacgactaccgacttcaaagtcaggatccaatcgatgataaaaaatgaggctcaatgacctccatggataccgagacattcgaggcaaagcctcgattttgccccgatctcaagccgccagcctactcacccactaggcgattcttgcaatcttccaatagcttttcaaacatgagcataatccacagttgatatctacgtctaacaatcttgattcataggttagtaggcggacttcctattctaaaggcctattagattaaggcctaacaatctagggattgggagccaaatggcctcctagactccagcgtaacaatctacggctctacctctatataaagagataacaaagggatcctcaagttagctcaactccggactccatcccaacgactgtggacttctcttgcaggttctcactttggcacctcgatcctcgatccacattcaacctcagccacattagcatcgaactggagttttgcagaaatatattagtgttagatgaagggtgaagtccactaaaaaaaaaagagaagatggcaaaaatgagagcgcacaactccaccgcctcctgttatggtaggtttacagccgtatgatatcctggttcagcagattcaagtgttggccaatgccgtatagcggctccaacagatgatggagtggcatccctcctcggagtcagcttcttggcacagctaccgatctcgccccaaagtctgggattagcccctgacgagcccaccacatcactcctgctctgctctctgccggtcaccttcctatcagagcttgaggaaggaagactagtgatggtgacctcccacctcctccaacagacgctcggctctaggttaccccatagaccaaaaagcctcttcgagaagatctcaaagtgaaaagttcgggatatcgagtgctgccttgacgaggtctagaatgggagtcactagaacgatgaagagaataacaaccaaccaatagttgatgtcatcaatatgatctccgactttttagggggtaggggataaaagaccgagtagacgaggtgaagagagtgcataaggaatattgttgatcttcgaagagctcaaacttttcaacatgatgctgttatcatatcaataataatagtaaattgaaaacttcgatataacttctattcttcggacatggaatgctgagaacatgaggatgtcttattagtaagctgtgtatccattgattatattaataaaaattaagcttttacataggtttcttgttgaagtgaccaagtaaaaagcctgactaaaggtgatcgtacccgactacaaatgaaatcgtcagaaggcaccgaagacatctcaagaagacatccaaaatataaactcgagacaagtggatcaagcctcatcccttcacatagccacctgacgctcgttcacagacaactcgagtagaagctgaggatgacagcgatggagctaatcctctgaagacctctcatagctagtcggcacttctgattcttggacgagtcgagtggaggccaccgacaatgatgaaggagctaatcctccgaggatccctttggccacttagtgctctttgtctagggatgagtcgagcagaggctgaggatgacgacgatggggctaactcttcgaggacattacatagcaatctagtgctcctcatccacagatgagtcgagtggagactaaagacaacgataaagaggctaatcctccgaagaacccacatggctacctgacgcttctcatccacaaacgagtcgaatgaaggtcgaggatgacgacgaagggggtaaccctctggagacccctgatggccacctagtgctccttgtctaatgacgagtcgagtagaggttgatgatgacgatgaagggactgccccttcaggaatcccacatggctatctggtgctcctcatctatggatgagtcaagcagaggtcgagaatgataatgaaggggctaatcctctagggaccccttatggccacctggtgctttccatccacagacgagtcgagtggaggccgaggatgacgatgatggggctaactcttcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacatactgtttatgttatgtccctgatgcgagtttgcgagctaaggatcatgacagctgccgcatactcatggatactttctccacaagcatacaaagcatctcatcaatcatcatgctatcataaagcaacagcagaacaattagtcaataaattaagtctaaaatttaattaattaaaatctaagtttaatatcccataaaattcaataatattcaaatgatcttacattaactttaataaaatttcaatctaaaataaaagtatcaaaattctacttctaattactctcccatatatatttttgtgtcatcttaattctcaagatctataaaaataataaaatatggggtaatgagttcaacaacccaataaacaatgatcactttaactagattaaattagataataaagtaaataataatttataaaaaataagcatatataattcatcagttcgaaattaatttctattatacagcattatcaaaatattatttatgccaaattcaatccctttcaaaattcacatttcgttcataaaattaatcttttaaaatattaaattctcatcaaccataagctatgaccatcttatccctatagcaagatgatcatattgcgtatcatcttactataagctatgtatcatcttgcggtaaatgtttaggaactgcatatcatcttacgatgagttgcatgtcatcttgcagtatgctatgcatcatttagtagtaaagtcttgatgaaccacgaatctgctgatggtttgtgcgaatctactggcaacatgtggctatctatatgcgaaataaatctttcggactaataattgtcatcgtattagcctcaattgacaggatcctccacatggttaagcagagagttcaagtcatctcgaatcaaaactcttttcacaaatcatatttaatattttagttcgataaaaatacacataatcatgtagtatcgaaattaatcaaatgtaatgcttaacaagatcaatactttcaatcattttttatcataatatttcagaataagatatattcaattcatacattatgaacagtatgattcaaaaattattgatataacaatcttataatttatcaataatctaagaaaagtaaagcactatttatctcatacgtatttcaaataaatctcaataatttcataattcttttttcaaaatcttcaattaatagattgtcataatatcccactacccgatatcttcttatcaagatgatcacatccctatatagaatcgagtccaacattagaaagagtatgaataagtatgaaaatgcatattgatggtggtcatatccaacgatttgggtttgtctagttatccttacttcatcgatcaagattaggctgggataaagatggttcaacaaagatcaaggatgatcaaatcaatagtgttcaataaaaatcaaagaagaggtcaatatgccattcaatgattatagatcgacttaatcaagtaattttatctaatcaaagtcagctaagatacaaaaactcaatagatatcaataaagatcggattttatgatgttcgatgaagacttggataatgcaaatctgttgtctaattgacaaggtgtttagagtttggctattggagcaaatcgtattcaaaatgattggccagaaatccttcattaagtttataaattaagtgaagagagaagagcagagaataaaaaaattaacgagatacaatagaactgatctggcaatactgcccgacaatttgatcaatctatttcagatgatttaatcaaatcatgaccgaattaccatacagatgattcaataaaaatcatagatgatcaaatctagtggtacatgatctgactaagatgagtgccagtatgatgcttagaaaccacagatcaggaccccttcatcaaaatcagtaaaatttatcaaaataaaattctttactagatcaatcttataaagtaaacttctagagattgacataattttagaggaaaatccataaaaaaaacaaacagtctagagaaaaaattttagagaaagaaaatagagagacaaattagagagagaaatagtggaaaaagaagagctaggaaagagagagatttttctttttctttctttttctttctttccttttcttttcttccttttttcttccttcttcttcctcacattttgggggtgaagcaggggatttcatttgaatccctttctccccaaacccaaggggagccatgccaagaaaggaaggctgaggatgcagcctatgatggtgcagccatagatctccggtccagtgctcaatggcaattgatggtgttagaaatcaaggaaacacagacggcaaaaatagggcatccactttccaactaaatttgataaattgtcgattgaaacttatttttcaaaggctataaaaaaaagggagggggttaatcaacgagggccgactttgtacctaattttctgacaatttttggcctgtgatttcgatgaactcaatgaaaaatcatgaggagaagaagaaaaaaaagataactttttcgatgatgataggaggctagagttggtgggtttcaaagagaggcttggcccctttttaaataaggctggggggaggagttgtgtcctccccggctttgattaccatcaagagatcctgaggaagaggaccattgatgggagtccaattcctcccactgatgcacgtgctggccaaattttttttaatgctgcttcaatatctgtgcaaaggcctcgttgggccctttttctatggggttaggctcctataggctagggtggtatagtttatctaatagtcactcatcaagaaaaaataaatttataccctatgttaaattatctaggatattcttattttattttattaatttttcttagtgaatgacatgtttatcatcatggagtagtttatatgagaaggaataacatagaaacgaaaatattggttaaaatcatatgattatagatctagatgttggtaaaaagaaataatcctctctttaaaaatccaaatggagttcattaggtgccttttttttcattcagcaagattgatcatgtaccacttgaaaaatatcatattagcaattataagtgcaacaacctattacatttataactagatggaattcacatcaaaatatgaaaacaaaaagtaacacttactaggactagtccactatttttcttataaggaaataggcttctagtttctaatactaaaattcctatttttaaaaggtctcgaaatccaagtgcagtggctttaatgaagatacattagtttttcacagaatattgatcactaattgtctatattttgatacgctcacaacatacctttgcataaatgctatataaactttttaaaacgatacatcataaataacattgcattatatgttcttaaatgcttttgccaaagagtgctcacccatctctccttaattttagccaatggataagggtattaaagatcatttctcaaaagtatcttgtcgataaaaattgctctagcagttaaccttcatttcaagtgtatcatggtgctctagcattcataaaatcaattagattgatatagactaatgcatattactactcaaatccttattgataatacttaaataatgcgccaattcaatttgccatcattgatttatataatttcattattctatctcttttaaaatatttgcatcagataaaataatgggatacatatatagatatatatccatatgcatgtttagattctatcctccactcgctcactgactctctctccccccccaaaatatacaaatatgcacaatagtatcttttgtatttataatagacatctcctcaatttaaaataaaatctctcaagtttcaaaattttcaaaatgatcccaaaagttagttaagtaatttaatatattttcatcatccatctgtagcaccaccattgaacatcaataggttaaattctttaggagataaattattatacttaataattgtaaaattctatcgaacatcaaaatgcggaaaaattttattattgatatcatcattagaagataggaggagataatgtcactatatttatacatattagaccataaggaacgatgcaaccaaaggaacgactatctaaatagcctacatagcttaccatatctgactgatgaggaatagcatggtgttagagttcagatggtgcccagtgagatgcacccttaagagagcctttatttcggcaagggagctaattgaagtgactttgaggccctatgagacctaggattcccatcctacccttacagcgacttgatggatatttatttcctgagagcccccacctctagcatttctcaaagtcaattttgatggtagcgtcagagacaaaagtggtggtgctggcttcgtgatttgaggatgtggttccgacctaatagcggcaggggggagccagttgtttgagcctacgatcccagaagcggatctccatgctgcttcgatgggtagtgttgatgctcgatgacttgcatgttgtccatctcattgttaagcgagacttcaccatgattgtgacttagttacagagttgcaggcagggagtcatagctcatcctcttctgcaggacatcaccacttggctgttgtggtgcaccagtcttgccattagacatgtattcgaggaggttaatacaatgaaggactggatagccgcctatgttgctgaacatactggggataccctacggacgagtgtggaggcagtccataggtcatttagggatattttattttctgactcttttggatgtactcacataaaatttatatgaatgatcagtttttagtaaaaaaaaaacaagctaaattaatttgtaccatatgtattaaattatccatcacatgtttattttattttattaattttcttggcgaatgacatgtttaccatcatagtcatagagtagtttgtctgagaaggattaacatatagacaaaaatattggttaaaatcatataattatagatctagatgttggaaaaaaaataatcctctctttaaaaatccaaatggagttcatcatgtgccttttttttaaattcagcaggattgatcatgtattgtttgaaaaatatcatattaacaaatataagcttagcaacctattatatttgtaactaaatggaattcatcaaaatatgaaaacaaaaagtaacacttactaagactagttcaccatgtttcttataaggaaataggcttctagtttctaatagtaaactttcaatttttagaaggtattggcatcttatcaaatattttcatatcctaatacaattttattattttgaccataactttcttattcaagcttaattataggaactcaagttgttttgagaaattaacttaaaggtagatgtagttgaagtagttcgaattcaaaatccatgtacagtggctttgatgaagatacattaatttcttcatagaatagtgatcgctaatagtctgtattctaatacacttacaacatgcattagcttaactactatataaatcttctaaaatgatacaacataaacaatcttgcattatttgttcttaaatgcttttggcaaatagcactcacccatctctccttaagtttagccaatggacaagggcattaaagattatttctaaaaaacatcatgtcgataaaaattgctctagcatttaactttcatttcaagtatatcactgtgctctggcatttataaaatcaattaaattgatatggactaatgcatattacttctcaaatctttattgataacacttaaataatgtgccaattcaatttgctgccatttatgtatataatttctttattctatctcttttaaaatatttgcttcagataaaataagggatatatatatatatatccatatgcacatttggattctctcctctacttgctcacttactctctctcatcctcccaaaatatataatcatgcacaatattatcttttatatttataatagatatcttcccaatttaaaataaaatctctcaaatttcaaaaatttcaaaatgatcccagaagttagttaagtaatttaatataatcccatcatctatctatagcaccaccattgaatatcaatagatcaaattctttaagagataaattatcatccttaacaattgtaaaattctatcaaacatcaaaatgcaaaaaaaaattattattgatatcatcattagaagattggaggagatgatgtcactatgcttatacatatcagaacgatgcaatcagaggaactgctatccaagtagccaacataatttaccatatctgactagtaaggaacatcatgatgttcgagtccagatggtgcccgatgaaattcatcctgataagagcccttattttgataaaagagttgattgaagtgacttggaggccttataagatataagactcccatcctactcctacagtgacttgacagatattcattttctaggaacctccatctccagcattccttaaaatcaattttgatggcagtgtcagagacaagagtgatggtgttggcttcatgattcgaggatctggttttgacctgatggtggctcgaaagagccggttgttcgagccaacgatctcgatagcagatctccatggtgcttgggtggggattgttcatacttcatagtttttgcgtactgactatctcatcattgaggaagcactacaacagaatagggtattagtgatgcaaaaaatttatcgctaataatgaattttcatcgataaaaattattagcgatgaaattattgtcactaatattttatcgtaaataataccatcattgataattttttacgatgaaaaaaattttcgtcatcaataatcgatattaccgatcaaaaaaatttcattattaaatttttttttgaaaactatttacgatgataacttttagtcataaaaaaagataatttatgataaaatattatatcgctaataataaaatgattatttacaatgaatcacattcgttgctattaatttaattaaaattttttataaaaattaaatttaaaaaaatattagcaacataaatttttcatcacaaatatgataatttttgacataaatttttgttactaataaattatgaattatttatgataaaaatatttttactattattaatttaatataaaattttaataattttaaatttattaaaaaaattatttacgatcaatttttcatcgttaatatattttttgacaatcaatattttgttaaaaataattttatcactaaaaatttatatatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaaaagcttcctcttcatgcaaatccaaatttttatccatctctagtcggattggtatgtcatatacacctctaggtgttattctttatacgacatgccaattacctcgatactttagatcattcaaatatattacttattttgcttgagttgctaatatatacggttcattctggtaccatgttcgtgcaaagtttacactaataaagtatggatcgatatgaatatcaatctttttattgctaatatcccaccattcatattaaaataagaatacagaattatcggatccatatttcagttctatgatatctatcagcacaccataatattcaatctcttcttctccttcatatcttatcgtagtaatctcactattctggatctattatttcatctcaagcttccttatgtgaaatctcatttcttcaatgatacaggatgcatagtggttaatccttcgatcggggccacatgttaaattgtacaactcatccgtcgcaccctcttctttattgaaatacttatatttcatctacattataatataaaaaattatgttggttttaataattatttttataattattaaaaataatatattactagtacaacttacaaggtcaccaaatcattttgcaaattttctcctatattgatcatcagcatctatattattctctatatatagtatactcttgtgctcactgcaacaagtcatgatttttaattttacatcgatataaaaaattacttaaaactttaaacaatatgctaagatggtacttagtcaatgaaatctttaatttttttacaattatttagaacgtagaagtgtgtctcggatagctcattcacgtccataaattcatatctccttctaccaataggtcgaatcatttatttaaatatagacagtatcagttcattatcatcccattcacgatctgcgttacgatctgaatgattgaatcttctttcgatatcgtcaagatacatcgagcagaatatgacacactccgtagctacgtatgcttctgctatagacccttcaagccgtactttattacgcacatacttttttagggcacaaaaatctgtaaataaaaataaatttaaattttaaaaatatatttacatcttataactgatatgacaaagtgcatacaatttctttacctttcaataggatacatctatcgataatgtaccagtccgatcaaaagagctttctttgaaagatgaatagccaaatacaccataacatcaaaaagtaatggtaaaaaaaaattttctaacttacaaagaatgagcacgatattcttttcaaacttctcaagttagtcttcaatttttgataatacagttctcgaaagaacactcccaacttaatcaatacagtttgaacatcaccatccaaatagtcacgcataaccacaggaagcaagcattgcatcatcatatgaaagtcatgacttttcataccagagatattaccgtcgttgttgccaacacattatgatacgtttgaagcgtatgtgttagaaaactttacgattttgaactatctacaaaaactcttcttttcctcatcaaacaacgaataacatacaggtggcataaaaaatctatcacctcgatgaactaaatgcaactccgattggatttctattttctgcaattcaagataagcttttgtactatcttttactttttctaggatgttcaatactgtatcgatgatattatcataaatattcttctcaatgtctattacatccagattatgaccaagtagtagctacttccaatatggtagttcgaaaaacatacttcgcttcgtccaattcagctcagcttcaatacactttcgcttgtaagtacccgatattttttcaaattggatattttcaataacttcaagttattctaaaacttctgctctacttaactccttgggtggcagacgtcgatcgaacttaccatcaaagtattgattgtaatgggtcctccaagagtgattactaggtagaaaccgtcgatgaccaatgaagcatatttttcatccatgttttaaatataaggaagatgcatctttgttgcatattggacatattagatatcctttggtgctccatccaggtaagttttcatatgcagaaaaatcatttattggtccataaaattagatcatgcaacttaaaatttttttgactcacagaatcagatgtctgtacttcattttcccatagctccttcaaaacatcgattaactgtcgtagatatacatcaatttcattacctcatgctttcaaatccgaaatcaatagtgatataaaaataaatggttctttcatgtactttcaaggtgacattatatacaactagcatcataggccacatactgtaggaagtactcaaattgccaaaaatgattaaatccatctgtcgctagaccaagacggatattgcacaggtcacctgtaaagtacggatgctttgcatcaaagtctatccacactataaagtccgtcggatggctaagtatattctcctccgaaactcactgctcatgatgtcatcttattttttcagctgtctttgtggacatatacaatctttaaagtcttgaaatcaatgaaaaatatctcaaaatcttttgaggtatcttattttctttcctattatcggttctgtacctaagctcaccgcatttcggacattcagttgcctattcattatccttataaaataatatacagtcatttttgcaagcatgtataggaatatagtcaagtttcaattttcgcatgtatatttttgcttcaaaatatgatttcagaaatctctctccatcgggaagagctgttttaatcaatgtcaaattttgatcaaatgacttctgactccatcgattcacgattttaatatgaagcaattttatcaaaaattctaaacttggagaactttgcacaatttggatagagtggctctcgtgcatccattataagctttgcaaactgtttgaaagtctcttctacctcaagccggatattgtgttcatgattagaattgccttcagatgcgctaatactcatgcatatatttgaacaaatattctgatgtaaatcatgcaatagttcttctataccatcatgttcgataggttcaacagcatcactattatcttcaatatcatcatcatcgcgcacaacttcattcgaatgaccctctccataccatatccagcgactatacttcttgtctataccataacgtagcagatgctcttcaacaaatgttatgtgatgatataccatattgacacatcttttgcatggatactttatccgactagcactgtcagccttatgccgtgcaaactcaataaaatctcaaataccttttcgatattcaggtaaaaaaatatctctgatatttatccaacttttgttgatatccatctaacaacaaacatgaaaaccattaacaataaaaaaattttcagtggtattcgaatcggattcgactcgaatttcgaatcaaatctcgatccggatccagacacggatcattttatacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcatcataaataattagttatttatgatgagcatttattttttcatcataaaaaaaatttatttacgatgaaaaatttttatcataaataatgagtaattttttattttttaaaatttataattttttaaactatttatgatgaaaatattttcatcataaataatcaagtatttatgataaaattttttatttatctcaaatactcaattatttatgttaaaatattttcatcataaataatctataatttttaaatttttattttttccaaatattggagatgataatattttcatttgaaataatattatttttgatttaaaaataattttcatcataaatacttaaattatttatgatgaaaatattttcatcataaatatttagaaatttaaaattaaaataaatgatatattatttatgatgaaaatatttatcaaaaataataaatatttataatgaaattattttttcattgctaataggtaattatttgtgatgaaaagttatttttattgtaaatattttgttatttatgatcaattttttttcatcataaatacggttagtggcgaccaaaatatttacgttgcaaataattttatcacaaaaatactcttttcttgtggtgaagactctattatgattgtgacctgattacagagctgcaggtggagagtcacagctcaccctcttttgcaaggtatcgtgtcctggctaatgtagtacaccaatcttgctgttaaacatgtcttctgataggctaatatggcagcagactggatgaccatctatattgctaaacacaccagggatatcctatagatgagtgtgggggcgttctctggactgtttagagatattttattttctgactcttttgaaagtattcatataagatttatatgaataattttttttaacaaaaaaagaaaaactaaatttgtactatatatgttcaattatccatgacatatttattttatttattaatttgctttgtgaatgacatatttactgtcatggagtagtttatctgagaaggaataacatataaacaaaaatattggttaaaatcatataattatagatctagatgttgctaaaaaaaataatcctctctttaaaaatccaaatggagttcatcatgtgccttttttttcattcagcgggattgatcatgtacagtttgaaaaatatcatattaacaaatataagcgccgcaacctgttacatttgtaattagatggaattcatcaaaatatggaaataaaaggtaacacttactaggactagttcaccatgtttcttataagaaaataggcttctagtttctaatagtaaaatttaatttttagaaggtatcgacatcttatcaaatattttaatatcctaatattgttttattatttcgaccataacttttttatctgagcttaattataggaactctagatgttttaagacattaagttaaagttagatatagttgaagtagttcaagtttgaaatctaagtgcaccggctttattgaagatatattaattttttcacagaatattggttgctaataatctatattccgatacactcgcaacatgcattagcttgactgctatataaatcttctaaaatggtacaacataaatagtcatgtattatttgttcttaaatacttctgctaaagagcgctcacccatctctccttaagtttagccaatggacaagtgtagtaaagattatttcttaaaagtgtcatgccggtaaaaattgctctagcatttaaccttcatttcaagtgtatcatggtactctagcatttataaaatcatttagattgatatgaactaatgcatatttctactcaaatccttattaataacactttaataatgcgccaattcaatttgccaccatttatgtatataatttcattattctatcacttttaaaatatttgcttcagataaaataagggatacatacatacatacatacatacatacatacatacatacatacatacatacatatatatatatatatccatatgcatgtttagcttctctcctccactcgctcactaactctctctcctcctcccaaaacatacaaacatgcatgatattatcttttatatttataatagacatctcctcaatttaaaataaaatctctcgagtttcaaaaaaatgatcccaaaagttagttaagtaatttaatatagtcccatcatctatctatagcaccaccattgaacatcaataagtcaaattctttaagagataaattatcattcctaacaattgcaaaattctgccaaacgtcaaaatatagaaaaattttattactgatatcatcattagaagataggaggagatgacatcactatgcttatatatattagagcatgaggaacgatgcaactagagggaccactatccaagtagcctacatagcttaccatatctgactagtaagaaatagtgtggtattcgagtccagatggtgctcgacgagattcacgcttgaaagagcccttatttgggcaagtgatctgattgaagtgaccttgaggccctataaaatgtaggactcccatccttctcctatagtgactcgatggatattcattttctaggagccctcacctccagcatttctcaaagtcaattttgatggttgtatcagagacaagagtagtagtgccggctttgtaatttgaggatttggttccaatctgctggcgtcggctagagggagccgggtgttcgagcttacgatcccaggagcagatttctgtgttgcttgaataggaattacttatgctcgacagtttctacatgctgaccacctcatcattaagagagactccgccatggttgtgacatggttacagaactgtaggtggggagtcacagctcatcctcttctgcaggacatggtaatttggctaatgtggtatattagtcttgctattatatatgtcttcagggaggctaacacagtggcagactggatggccacctatattactaaacacatcagggttaccctatgaatgaatgtgaggataatccctggccatttagggatattttattttctaactcttttggatgtattcactcaaaatttatatgaatgatttgttttcagcaaacaaaagaacaaactaaatttgtaccatatatgttaaattatccatatcatgtttattttatttcattaattttcttggtgaatgacatgtttattgtcatggagtagtttatataagaaggactaacatataaacagaaatattggttaaaatcatataattatagatctagatgttggtagaaaaaaataatcctctctttaaaaatccaaatggagttcatcatgtgcctttttttttcattcaatggaattgatcatgtactgtttgcaaaatatcatattaacaaatataaatgcaacaacctattacatttgtaactagatggaattcatcaaagtctgaaaacaaaatgtgacacttactaggactagttcaccatgtttcttataaggaaataggcttctagtttctaatagtaaaatttcaacttttagaaagtatcggcatcttatcaaatattttaatatcctaatacagttttattatttcgatcataactttcttatttgagcttaattataggaactcaagatgttttaagaaattaacttaaagttggatgtagttaaagtagttcgagtttgaaatctaagtgcggcggctttaatgaagatacattaatttcttcatgaaatattggtcgctaatagtccatattctaatatagtcgcaacatgcattaacttaactaccatataaatcttctaaaatgatacaacataaataatcttgcattattcgttcttagatgcttttgccaaaaagtgctcacctatctctccttaagtttagccaatggacaagggtattaaagatcatttctcaaaagtatcatgttagtaaaaaattgctctagcatttaacgttcatgtcaagtgtctcatggtgctctagcatttatgtaatcaatttgatacatatggactaatgcacattaatacttaaatccttattgataatacttaaataatgcaccaattcaatttgccgccatttatgtagataatctaaattttctatctcttttaaaatatttgcttcaaataaaataagggatacatatatagatacatatctacatatgcacgtttagattctctcctctactcgctcactgatcctttctccccctcccgaaacacacaaacatatgcaatattatcttttgtatttataatagacatctcctgattttaaagtaaaatctctatagtttagaaaatttcacaatgatcctgaaagttagtgaagtaatttagtatattccgatcattcagttgtggcaccacaatttaacatcaataggtcaaattgtttaagagat
